United States Patent 9,567,581 (SELECTIVE REACTIVATION OF GENES ON THE INACTIVE X CHROMOSOME) - sequence listing, part 61

SEQ ID NO: 9302 - DNA, 1854 bp, artificial
  synthetic oligonucleotide
ctcaaggggttagcgggaattatacaagggtgtgactcattgggagttaccttaggatgtgtctgacacaaatagaaactgtttctttggctcatttgaaaatttccttaaatatctattatctttaaaaatagcttaatgggtttttttttgcttttaaaataaaaaactcttttttggtaaaaagattattgaatatgattatttatctcactttgaatactcgtgggctactggggagtcctacatagtctggcttcctggtacctgctgttccccctgcctaaagagctcttatatcagatatcagtgcaccatggttctaggcacatagtaggtgctcaataaatgtagtttgactaaatgaagaaatgcatgaaaaagggtgttttctttgcatacagcagacacttgaacttttttttataccaaagagcttatcttaagtgtatggtctcagcctaccttctctgccaatggaggattcaagaggaaacaaatagccttttcagtacaaaagtgacagtagcatcaaaagctataacttagctgtagtttatggcatgcacaatgagattcaaggtcagctattcattcttctaaaaaattaagtaacatttggcttacaaaagcataggcaatataagtgcccagagtattacctctctgaatcactgcttcttggattaagagcactatatggtttgtatcagattgattgttgattgaacgtgatgtgcacgtatgagtacagtcctagtggggccaacccaaagcatagatgagcttctcaagccagtgagcacatttccgttattactcaagggaaaatatatttgaagtcagttaacttttagctcttgtggaaaggatggccagcgtgagtgaaaaaaaatttatcataaagtatcatctgactcttctaaagacaatatccaagagttttattattcatagtatctcactatgagtgagacaaagtaatgggtcattcaagtatctattttgatgagttgctgcttggtaagaaaatttcatatgttcatgattgtgatggttaattttatgtggcaacttgactgggccactgggtgctcaaatatctagtcaaacattatcataggtgtgtctgtaagggtattcttggatgagactgacatttgaattggtacactgagtaaaacaaattgctctccctaatgtgagtggtccttacccagtcagttgaaggcttgaatagaaaaaaagggccctaatcttccttttaataagagggaattcttcctgcttgactgctttgagctgggatatcagtctatcctagtcttccaacttgaactggaatatttgctcttcttggatgttgagcctcccagctttcagacttgaactacagtattaactcatccagttcttgggcctttggattcagactagaactatacattgactctcttgggtctccagcttggtgactgcaggtcttgggatttctcagcctctgcaatcatgtgagccaatttccttgcttcctaaattctcttccagtggcagttccaaactttacaacttctttaaagctcctaaactaattttgctcaatttcagacaatgaactaggacacagattcaatgaacttgaagtcttgagtcttgacccaactgacatcccttggcgccccttgtctgaaggtcacagcacctgtcagatagccctttccatacagtttgtgttctctctcttctaataacggtttcatcctcattatttcaggctaggagtgggaaactgggctcagttgttgagtcatgggttgctacaccattccttgtgtaattttcctgctctccact

SEQ ID NO: 9303 - DNA, 2057 bp, artificial
  synthetic oligonucleotide
tcaaaataatatgggagagaggaagcagttgtcaagaattttgaagagtttcagattttaccctacttgccaggctcacaagttactctgccagttttatggatactggcaaaagacacaaggctcttgggttagagaaaaaggactttattatccacagaacagaaagcagcatgagttttatgttcacatcagatctctcttggttttcaagtctcatggaggcaatgcaaagtggctcagttggatattgtgcaagcagtaggtttgcatcacagctggggaaccttgagcttaggaaacatggatcttttataatgggaagttagcaaactttcttgactttgctttggagggagacattatctttatcatattggtcagtaaacaaatatgccctctactctgaagacagacactatctttttcatccaagactctttgctagacaaacatccttaaaaagagtttataacaaagtcagtgagcacctatgctcacaagacatgaggaaacacaagagacccatggagacttgtctcctaacaatcatgatggtagggaggaatacatgaaaaacaattagctgtgacttgataattattaaaactgggtgatgggtacattgaagtatagtctacttttgtatatttttgatgttttccatagataagttaaaaaaaaaaagcagctttataagtaaagtactgtgtgatactatacatatgtattaggccattcttgcattgatataaataaatacctgaaactggataactcataagaaaatatatataattggcttacagttttgcaggctgtacaagcatggcaccggcactgcttggcttctggggaagcctcagggagctttgactcatggtggaaggtgaaatgagagcatgcatatcatatggcaaaagcaggaacaagagagagactgaggagggagatgccacacacttagaaatgaccagatctcatgtgaactcagagtgagagatcatttatcatgaaggggatggcccaagccattcacgaggaatctgccccatgatccaaacacctcccaccaggccccaccttaaacattggggattacaattcaacatgagatttggtggagacacacattcaaactatatcattctgcccctggcccccaaaatctcatgtccttttcacactgaaaaatacaattcttccaacctctgcctgttacccatttccaaagtcacttccacatcaagtatctatagaaatgctccactcctcagtaccaattttcttttttaggctgttcttgcattgcttataaagaaatatctgagactgggtaatttataagaaaagaggtttcattggctcatgattccgcaggttgtataggaagcataatgccatcatctgcttctggggaggcctcagaaagcttacaaccattgtaaaaggcaaaagggggaacaggcacatcacatggaaaaagcaggagcaagagagagcggggaggtgctacacacttttaaataaccagatctcaagagaactcattcactagcatgaagacagcaccaagccatgagggatccacccctgtgacccaaacacctctcaccaggccccacctccagcactggggattacaattcaacatgaaatttggatggggacaaatatccaaactatatcaccatttaaatcacaataaaaaatgcccaatgagatggtggtaattaccatctcacatctctacctcactgaacaaatgtctgagatctattcagtaaatgttcttggaggctggtttgttagagtattgacaaattcagtgtgattaattcaaatctctacaggttaaataaaaccaactgtgaaagtcaggaacattggagaatggtagaaaatgacccttcagtttctagtttttggtgagcacaatacacatattacatatacataaatatatataccacaatatacatgtaacacatacattaatgtgatcgtatgtatataagtgagatgaaggcaaaggagacttcatttatgtacacggc

SEQ ID NO: 9304 - DNA, 1487 bp, artificial
  synthetic oligonucleotide
tgttttatgaatccttatcccctcaatgttttatacttgataggcattctacatgtgaatgtcttaaaatatagaacggcagccatatcacatttccaagaaataaattatttcatttaggtacattttctaggtgttgaagattgcacttttaaatactttttgatgggaatgtttctgaaagatatcatatattatccttacacaccacatagaagataataagaacaaaatgatgtttttttatgatgattcagggtgataatttagaaaccttaaatactttgctggggtgcaaatcagtaggatttttctttctaaatctttaggtgaatattggaacccactgtacaaggtgatatggtggggctttgtgttcccacccaaatctcatcttcaattgtaatccccataatctccacatgtcaagggagagaccaggtggaggtaactgaataatcatgggggtggtttcccccatgctgttctcatgatagtgagtgagttctcacaagatctgatagttttataaggggctcttcccccttcacttggcacttctccttcctgctgccttgcgaagaaggtgccttgcttcctctttgccttccaccatgattgtaagtttcctgaggtccccccaaccatgtggaactgtgcatcaattaaatttcttttctttataaattacccagtcttgggcagttctttatagcaatataaaaacagactaacaaggcatctgctgggctgtcagttatacactgtcacagctcttaatagtatactgacttcttgcaagtttcttcaatttcaaatttctgaggtctgagaagtttgatgatcaaagatgtcaggtttgtgagaaaataagctgccaagttatgtcctgagggcctctcctagagtggattactgggctttagtgttttggcaatcaacacgtgatgtatcaagtgctaaaacatgttgtattgggttctcatttgtggtcctgctatgcatcctgggacactctaagatgcagcatctgtgggaacactgtattcagaatccattcactattaatttatgattgactttttagatgagagaaagatttgagctgacaaatatcatccttacaggtgttaaagaattgaagaagagaccaagttttctttggcttattttctgatttagaatctttaaaattcatagttgtttttacagtctgagattagggaagattttaaagtagtgaagaaatagaacggagtgtaagaaaagcagattaagtttgcatctcagtgtttcatggtctctgaaacgtttgtttcctttttccaaaatggcagggaattcagtggtacattctatgtggtaagcagggacttatttatgtctcttccctgacaggaagctgaaaatagaaagtatcctaatatccacagctctttttctacatgatgtaagaaatgctcaggaactgaatgtgagttgaatag

SEQ ID NO: 9305 - DNA, 1192 bp, artificial
  synthetic oligonucleotide
tcatttctgcagtatcttgttgactgacacatcagccctattcagtgttcgaggggagtaaaaaagggcatgatccaggagacagagattattggggcatcatttcagagactggctatcacattgttagatacagacatgaaaccagtgtttaggaaggatagaggaaatatttttgggaaataaaagaatttagaatcttatctttattttcatcttctccatcttacatactaacaattcttgttgacatcaacattttaccttttcatcaatctctaccttttctggatttattaagtatgaagctcttcaaaatgaaaataggtgaaatttagacgtttgtctactctcactctttagaaatattgagtttttaatggtctctctgatacaaatatctcaatatatataaaacttggttagtatctgtatcttatttgaagtgaatactgtcttccacctctacaataattaccttcactttataggtagcttgtcttaaaaacagaagttatccttttttgtcagaattttagctgttccaacacgattgagcccatgttaagcagtaggaaaatgtttcttttttttatcttattatcttctaatctcaaattttcctgcagttcaatgaaattaatgtctttaacatttcccatccacactagaaccatgctagaaagtgcttttataatatttttaagggggtgatatatgaaaaccctcctataattggctaaatggagacattagagaatcaaatacttcatcctttttcgaagcactgcttccatggggcaatataagctttgaaaagtggatgcaattttatgaaattggtgggttatgatgcattaaaatctagaaagtgttcatttcatttcaaatagaggtcttgaaagtaatgctccttacttacagctgcattattttaataaaacttcagcgataattattttaaaaccaacatcctaggtttaaatgaaaatcacaaaaaaatcgatttaggactttagaacttaaaccataaaagttgctagggtctatttaatatacttagagagatttgaattaaataaatagtttctgccatcaccaaacctcactccagatgatcttgtgtgggtcccttgtctctctgactgcttgcatggtgtaacctaggagaactgcaagttccctggggcct

SEQ ID NO: 9306 - DNA, 1519 bp, artificial
  synthetic oligonucleotide
gggcacttgttagaaatgcaatttttttgtgagccatccaagacctactgaatcagaaactctggggctggagcccagcaatctaatggataagtcctctgggtgattctgagccatgctctaatttgaaccactagtgtgtcatagacggcaagtaaatcctgctttgttttacttatttatcagttacaaatacaattagctgccaaaacaagaaacaacaagcccccaaaaaacccagcaaatagtggctgtgtaagtaagaaagaattttcttattctcataaaataagaattagcaaggaagccagtccaggctgttgtccagggctcaggcatgatgtctagggattcacgatccttctagcttcctatcctgccattcttaggaagtggcttttgccccagagttgcaagatgactgctgtagttccaggcattacttctatgttccaggcaaggaaaagagggaaggacaaagggcttctcctatttttcttcaggtaaagtaactctgctcaggaatttctgcctttatctcatggtcagagctatgccaatatggctaattctaataacactgcaggttaaatctactttagctttctgtctttatgatagagaaggtcaagggaaaacgaatggtggtaagaatagtttggggcaggccaattcatactattgccgtcagcttgcaccttgcagctaattctgttgctttcttgtttttggttgaaattcttggagtaggctgttatgacaaaagtgaacattttaatgtttaatagggaaataggatcaacaaattatctttccatttacattttaattctgacagctaattcaccaaggaaaactcaggttttatgtacaactagctattttacattacgttaagggtttggccggatttgccttctagagatgtaatggaagatttgtgaaataatgtaaaacaaagcaaaataagaaataatgtaaaatactgcacaactacacatatttgggctaattatattggcgagtctgaaaatttgactatttcaagatatgcatctattacttctttaaaatataaataataattagaattaggctccagggctgtctgtcacatataattttcttttattgtaatgcatagataataatgatagttggcttatttatagtgagaattgtttctaaattagtatagcagtgttaaagcaatttataggtctctgcaatcctatttatttcttgacaaagccattcctcttgcattttaaatgacaaatttgcccagagtctgttgaaaatattagtaattttgatttaatgcagtgcaagtatgtgagctattgttggactcattaaggttgctgcggtaatcatctagatggtaggaaggactagagatgatcaatgatatgactggggtataagaacttactcatgtcagaactagggtcaaaacagagatggttggacacacatcctgtgttcattttctctagattccaaagttctagttttt

SEQ ID NO: 9307 - DNA, 883 bp, artificial
  synthetic oligonucleotide
acttgcgacttccctaggaattctcatgagcaaaattctctgtctcacactgaaagacaacatcatgggaggtgacatcacctttcagctcaggtggtttttgtttgtttgttttgtaaaagagataatatattgattgtagaaagttctggaaatcccaagaaaataattaaaataagatttaaaacatcaactgctatccttccacccagggataatctcacatttgatgttttggtatacttcctttctttctcttttttttttttttttttttagtttctttctttctttctttttttttttttttaattttactttaagttctgggatacatgtgcagaacatgcaggtttgttacataagtatacatgtgccatggtggtttgctgcacctatcaacccgtcatctaggttttaagccccgcatgcattaggtatttgtcctaattcagctcaagtattaagtctttctgaaaaatcgctaacttgtaccaaactgcagatttcattcgttctaaggtatatatcccccttgctgtacatttgacatctgtgaaattggatgtgcattatgattgatagtaggtcagaaattaatttttggtatgcttttcttagtggtatatgaattttttgtggatcttacagttaatgtcatcttagattttctgaactacagtaacattaacatcttgctcagaaaatgttttcttgagatagaaacaaaagagcccctgtctgaaagttgtgtagagatgaactgtgggaagggatcagggtctagggagaggcaatagtatctgcaaggtacttggggtgggaagagaatggcctgtccaagaagttaaaagcagttttgggggaaggagaacagacagca

SEQ ID NO: 9308 - DNA, 291 bp, artificial
  synthetic oligonucleotide
gaagaataatgagatttaactcgctctttattcatttttcatttctgtgcaagtgctttcatttccttcacctttgagctctgatcttttcccactgatttttgttttttgttccaatgggaagcacccttgtctaaaggtaagcagtgatgcttctaccgaggccacacctttgtctcagcaacatgatgttgatttattcctctctctctctctggtccaagctgaaccctgccttattcactcctaactcttatacagagcttttctcctgtgcctgctacatagaaa

SEQ ID NO: 9309 - DNA, 8443 bp, artificial
  synthetic oligonucleotide
aaccagttaatcagttaaccagactgatgtaccttgaagctgcaagtatttcctacatgacctgcaggaaagatcctgctatcatttttctccaacgaagatgctgaaattggtgtgaatgcaatgaaaagctgagatgcaggtggaaattcatagatagttttgtcatcttgaaagccaattatttgctccaatgccacatttccagatccaaggtttggggacacatttatctctagtgatcatgtaaagcattgtaactgtagcacacattttagaaataaaaagaaagaacaagaaaaacaatcttaaggttgctgtattcagaaattatcttcctcgagccctgtacacagcttggttggttagtcgtcttcactgaaattgcactgtcaccatcaacttaaccttttagttgggaaaataaatgttgaccttggtaagtgactattaggaaggaaacttaataaatctgtggcaacatcactagcagcacaatctatgctggcagtgctggccaaaaccattatgcagtttttctaatttcaattgaaagagaatgtttcgtttggtacggaattgcaaatgtgtggttcggtggatgaaagagccacccagcagtgactcaagctgatattcttgtagctacagtaaaatggcatactttaaaaaatgatgatgataactgttaataaaattgtaatattttacgatgaagctttatgtacagatgttcattctaggatgaatatttggttctggccttggcttgggccattgggcatgtagctaaaatgtgcattttttgcactcctggtttacaatggacaaaacttaaaattaacattggatacgcaggttcttaaaacaattctttggccccttctgcaactcagcagcagcttcttgtttccttgttcaggtctctctctttgctgctgcttctctggtttgtctctctcaggagccaaacacaaattccttcccttttcttaaggagcaatttgtccctctgtcacctcagctagggcctttccccgaccccggcaaccgccccataactaaggcctatactaagtactgaatcctagaggaacaccttcctcagacactttcagaaacaaaagtttatattggcaaatgtgtatagtatacgtaatatacatgcaaacaatataagatactgatattaaactaaataaaaatttccaatgggcggaaatgagggatgtataggaactctccatactatgttttacatatataaataaatatactagcatttttattttttattttttattttttttttattatactttaagttctagggtacatgtgcacaacgtgcaggtttgttacatatgtatacatgtgtcatgttggtgtgctgcacccattaactcgtcatttacattaggtatatctcctaatgctatccctcctcactttccccaccccacaacaggcccccgtgtgtgatgttccccttcttgtgtccaagtgttctcattgttcaattcccacctatgagtgagaacatgcagtgtttggttttttgttcttgcgatagtttgctgagaatgatggttttcagcttcatccatgtccctacaaaggacatgacctcatccttttttatggctgcgtagtattccatggtgtatatgtaccacattttcttaatccagtctatcattgatggacatttgggtttggctattactgtcattataatttttgatattcaagttgtcccatatttttgccagtgagaacacttccagattggcttctgtgttttttttttaacccatttatgctggaggctgcacattttttttgtgaaaaatcagaccttggcaatgaccttgagcagtaggatatacataactcccacaggtttagcgttccaacaatggaacactgggaataaatgggttaaacattgtggtaaagccgggtgcggtagctcacacctgtaatcctagcactttgggaggccaaggtgggaggattgcttgagctgagaagtttgaaaccagcctgggcaacatagttagacctcgtctctacaaaaaattagttgggcttggtggcacagctgcttgggaggctgaggcaggaggatttcttaagcctgggagatcaaggctgcagtgagttgtgattgcaccattgcactccagcctgggcaacagagcaagaccctgtctaaaaaaattgtggtaaaaaacacatagcactaaatttaccatctcttaccatttttaagtgtatgattcggtagtattaagtatattcacatagttgtgcaacagatctctggaacttttattttttattttttttatttttgagatggagtcttgctctgtcaccaggctagagtgcagcagtgcaatctcagcttgctgcaacctccgcctcctgggttcaagtgattctcctgcctcagcctccctagtaggtggaactacaggcacgtgccactacacccagctaagttttgtatttttagtggaaatggggtttcaccatgttggccaggatggtctcgatctcctgaccttgtgatctgcccacctcggcctcccaaagtactgggattacaggcgtgagccaccgtgcccggcctagaacttttctatttggaaaaactgaatctatatccccgttaaacactatttccccatccctgtccctgcttcctcagcccttggcagccgcctttctgttttctgttctatgattttgatgactttagctatttcatatcagtggaatcatacagtatttgtccttttgttgctggcttattttgcttagcataatgtccttgaggttcatccatgttgtaacacgtgtcaatatttcctttctttttaaggctgcatagtattccactgcatggatatactacttttttttttaatccattcttccatcaatctgttgcttccacctcttggctattgtgaataatgctgtaatgaacatgggtgtgctaatatgtcttggagatcctgctttgaattctttttgatatatactcagaaatggaattactagatcatatggtaattctgttttttaattttcttgagaaacctgcatagtgttttccatagcgactacaccattctctctatactatctttacaattttatcacaaatctaaaattattccaaaatattttttaaagtttatttaaaaaatagaagaggctgggcatggtggctcatgcctgtaatcccagtgctttgggaggctgaggtgggaggatttcttgagcccggtagttcgaggctgcagtgagctataatctcaccactgtagagactgcactgctgcagagaggtatgatcccactctgtgcctaggtgacagagtgagaccctgtctttaaaaaaaaaaaaacaaaaaaattacaacacattgttattaacttcagtcaccatgttgtacaatagatctcttgaacttattcctcttgtctagctgaaactttgtaccccttgacaaacatcgccccaatatccctctccctctgcccctcataaccaccattctactctctgtttctatgagttcaacttttttagattctatatataagtgaaatcatgaagtatttgtctttctgtgcctggcttatttcacttaacataatgtcctccagttgtaatgtcagtataatgtcacattgttgaaaatgacagaatttcatttttttttaaggctgaatattattccattttgtatatataccacgttttctttatctattcatcctaagttgatggatattttgttgattccttatcttgcctattgtgaataaaactgcattgaataaaatcattttaatgtatcctcacaatatccagtgtggaagacatgcagcaaagaggactctgatattctgctggcaaggatgtgaatttctaaacccatttggaaaacaatttggcatcatctagagaagtgaaaatgcacgtaacccatggccttacttctacactctaaagaaactctgatctctgtgcactaggaaacataaaaaatgtccaccatggcattattcaaaatagcagtaaactagagacaacccaacagtccactgacagaataaatgaataaataaatggtgatatatttacacagtggaatactgtaaaaaagtgatcatgattgaattagagtttcacccatcaacatggatgagtgtcacaaatatactcttgaataaagagtcacagaatgtataatttgaaaacatacacaatatatatacaacatttaaatgcaagcaaattttcaagtattctttatagtctttttaaaaaattatatttatttgtttgtttatttatttttcagacagagtctctcactccgttgcccaggctggagtgcagtggcatcatcacagctcactgcagcctcaacctcctgggctcaagcaatcctcccacctcagcctcccgagtagctgggactacaggggagtgccaccatgtccagctaattttagtatttttttgtagagacagggttttgccacattgcccaggctggtctttaactcctgagctcaagtgatctgccagctttggcctcccaaaatgttgtgattataggcatgagtcaacacgcccggcctaaataagtattctttaggaatacgtatatatgttctaaagctattaagaaaatgaatagactgggcatggtggctcatgcctataatcccagcactttgggaggccaaggcaggagaaccccttgagcacaggagtttgagaccagcttgggcaacatatggagatcctatcttgtaaaaaaagaaaaaggaaaagaaaaggaaatgagtaataaaaagagaataacacaaaattcaagattttcaagatagtagttactgctggagtgggatgcatgagtaccctaaaaccattggtaacatattgtttcttggattgagtggtggacacagatatttgttttattaatttgtataccttatgtattagtttgttctcatgctgctgatgaagacatacctgagactgggcaatttataaaagaaagaggtttaatggacttacggttccatgtggctggggaggcctagtaatcatggtggaaggcaagcaggagcaagtcacgtcttacatcaatggtggcaggcaaagggagagcttgtgcaggaaatctcccccttataaaaccatcagatctcgtgagacttattcactaccacaagaacagcatgggaaagacctgcccccatgattcagttacctcccaccagttccatcccacaacatgtaggaattcagattgagatttgggtcaggatacagccaaaccatatcattctgcccctggcctctcccaaatctcatgtcctcacatttcaaaaccaatcatgccttcccaacagtaccccaaactcttaactcatttcagaataaactcaaaagtccacagtccaaagtctcatctgagacaaggcaaatcccttctgcctacgagcctgtaaaatcaaaagcaagttagttacttcctagatacaatgggggtacaggcattggataaatacagccattccaagtgggagaaattgaccaaaataaaggggctacaggccccatgcaagtctgaaatccagtgaggcagtcaaatcttaaagctccaaaatgatcttctttgactccatgtctcacatctaggtcacgctgatgctagaggtaggttcccatggtcttgggcagctccacctctgtggctttgcagggtacgccctccctcctggctgatttcatgggctggcattgagtgtctgtggcttttccaggcacatggtgcaagctggcagtggatctaccatcctggagtctggaggacagtagccctcatcttacagctccacttggcagtgccccagtagggactctgtgtgggggctctggccccacattttccttctgcactgccctggcagaagttctccatgagggtcctgcccctgcagcaaacttctgcctggacatccaggcatttccatacatcctctaaaatctaggtggaggttcccaaaccccaattcttgacttctgtgcactcacaggctcaacaccatgtggaagctgccaaggcttggggcttccaccctctgaagccacagcccaagctctacattagctcctttcagccatggctggactggctgggatgcagggcaccaagtctttaggctacacacagcagggagtgctgggctgggcccatgaaaccactttgcctcataggcctccaggcctgtgatgggaggggctgtcatgaagacctctgacatgccctggagacatttttccattgtcttggggattaacattcagctcctcgttatttatgcaaatttctgcagccagcttgaatctctcctcagaaaatgggattttcttttctatagcattgacaggctgcaaattttctgaacttttatgctttgcttctcttataaaactgaatgcctttaacagcatccaagtcacctcttgaatgctttgctgcttggaaatttcttccaccagataccctaaatcatctctctcaagtccacagttccacaaatctctagggcaggagcaaaatgccagcagtctctttgctaaaacataacaagagtcacctttgctccagttcccaacacattcctcattttcatctgagaccacttcagcctggactttattgtccatatcactgttatcactgttagcattttgggcaaagccattcaacaagtctctaggaagttccaaagttttccacattttcctgtcttcttctgagccctccaaactgttccaacccctgcctgttacccagttccaaagtcatttccacattttcagatatctacagcagtgccttactctactgctaccaatttactatattagtctgttctcatgctgctgataaagacatacccgagactgggcaatttaaaaaagaaagaggtttaatggacttacagttccacgtggctggggaggcctcacagtcatggcagaaggcaaggaggagcaaatcacatcttatatggatggcagcaggcaaagagagagcttgtgcagggaatttccccctgataaaaccatcagatctcatgagacttattcactaccatgagaacagcacaggaaagacctgcctccatggttcaattacctcccgccaggtccctcccacaacacgtgagaattcaagttgagatttggatggggacacagccaaaccatatcaccttatatgtgtaatataatcttttaattgtatgaagtaattcgtggtagtttgggtttttgtttcatttattcatttgagacaggctcttgctctatcattcaggctggagtgcagtggtgtgatcactgcatactgcagcctggacctcctaggctcaagcgatcctcccacctcagcctcccaagtagctgggactacaagtgcacaccatcatgcccagctaatttttgtattttttgtagagatggggtcttgccatgttgcccaggttggtcttgaactcccaggctcaagccatctacccgtctcagcctcccaaagtactgggattacaggtgtgagccactgcacatggctcattttgtttttataattattattatcatcattattattatttttgagatggagtcctgctctgtcacctccgctggagtgcagtggtgcaatctcggctcactgcaacctccacctcctgggttcaagcaattctcttggctcagcctccccagtaactgggattacaggcacacaccaccatgcccagctaatttttttgtatttttagtagagacggggtttcgccatgttggccaggctggtcttgaacccctgacctcaggtgatctacctgcctcagcctcccaaagtgctgggattacaggcgtgagccactgtgccctgccataaatattatctttaattcagttttgttcactatttactggctgttgatgtacccttgtaaattactctgatttactgcataacaaagtgagcttttttatttagtcattctaacataaaattttttatcatgctgtgctttttcacaaatatgtaattgacaaatgcaagttgtatatattcaaagtgtgttttacttttctttaatggatggtaaagacagtaaaagctaagagagagattagcattggcaggatttccatagcagagcccttcaggaggaagtgagacttttgttgggtcttcaaagggagaagtcacataatctttgaaagtggaaatggacgttagagttcatctgccccacctcttcctttagcagatgaagaaatagaaatctagggaagtaccgttttcaaaaaaggctttaa

SEQ ID NO: 9310 - DNA, 975 bp, artificial
  synthetic oligonucleotide
tcttgcagactagaatgttggtattttgttttgttttaatttttgtagggacagagtctccctatgttgctcaggctggtcttgaactcctggcttcaagtgatcctcccaccttagcctctggagtagctgagattacaccttgccaggccagaatgttggtgtttgataagttaccaaaagtaagcatagatgagggcaatactcctaataaaaatagatttttggagtgctgaataacaaataatcacctcttttagttataaacctgcctcgaaaaagatatgaatgtatttgaagttttgtcccaaatatatatatataattacatgtaaatttatttatagatacatttacattctacccttttgcaatctatttttaagcctgcagtagtaattcgtatcatgacctggaacactactacagttttaactaacatgaacatccccatagcattattattatcaggaatgaaaaaatggcagattatagaccaagcccaactcactaatctccccatccctacacaggatgtcctggtataagtggactgatggctaaaacaggaattgttagtgttttctagaaatgaggaatatattgagaacatcaaatatgcattcactggcaaatccatcctctttttgaggggggagtccactgatttccagtgtcttttattctacatacttgctttcttctctctctctgtttttttaaagagatggggtcttgctatgttgcgcaggctgaagtgcagtggctattcacaggcacaaccatagtgcactacagcttcgaactcctgggctcaagctgagagtacaggcatgggccactgtccttgactctgcttccttctcctcaaatttcttcaagtggccccaaattaccacctcttcagtttgcaggcccttctgttaagtgagtctagaaggggtggccacaaggaatgtttcagatgttgcttct

SEQ ID NO: 9311 - DNA, 2133 bp, artificial
  synthetic oligonucleotide
ggagagaagtgagttgcgggcgcggcgacccagtggcgggccgggcaggctcggggtggggtcgtcggggcgcgcgcggggtggcggggggcgcgcccagtcctccctccccctctcccccatccccggcgccccctttcgcccccagggacttacggcggccgcgggccgcgggcgcggcggagcttggccggcggcggcggcggcggcgaaggggaagcccctgtcgccgtgctgaggaagagaagccgtggtgctgtggggaggacacccggctggcatagggcaggcttaggcggagaggggagggcaagctgacagaccccgccccgggggccggacgagggaggagccggggctgcggcgagctgaggggcgggctaggcgacgcgcgggaagcggctcagcggtcgccagcggcaccggaggcagcgcgggtaaccgctgagtccaaggcagccgattggaggtttcttcgctgaggggaggtgcgaaccggaagccgggccacgtgacccggaagcggcgtttgccgggcccgagcgcccgcgcgcccgcgcgctcttgcaggtgcctccgggacgcgcgcgggcggctgtcctgcttgtttaatgataggaggacgggattctgcagcgtccttagcctagcgggtggtgcggggcagggaagttccggacagcgaagagccacgttcgagctctaatgattctctgtgtccccagagaggaagtgtgaagtgtgacggctgacgaggagggtgggaggagacgagggagtgctgcaactctggaaaaacaagtcagctcttctgtggagctcgtcacgcattcacgggccttttgctatcattctgcctcaaaattgtccggaatccgccctctccttcccattgcactgctccagccctagcccagacaccttccgccccgagcttcgcgggagtctgttccctgggctcgcctcgcccatcctcggtgctgcggactggatgagttaccgtccgttcggctgaaaagcccggacagcacctcaccttcgagatcccgcttccttcacactgggtcgccccaccagccgcctgggttccagtttagcactgccgacgacttgctgtgcctggcatgtccttgctcccaaatgtcacatctatgaagcctcaccctaaaaccctgtaagagcgattccctctttcacccacatgcccgttagcctttatttagcacaccttaaattgtattcattttgcatctcaatctagttcacagcctggtatataacaactaataaatgtgagttgactgataaagactataaaatgataaatttgttaagagctgtaatgctgagcgtaatgcctgggcataatggatgttcataattttctgaatgatagaatggatgaatcatctagtcatttacagataaggaaaggggagtcccacgggattaggtgaccttccttgaagagccacgggtttcccatatcgaaatgctattcattacccgagtcacctaggttcttacaaaggaagcgagaaaattgcttttgttgggccatgccccttttgcagaggttcctaagtatagtcgccagaatttttttaatggcctaaagtaaaaaaagaaatgctaaaattttcacgaagctaaatgtaatcaatgtaaaggaatcctttattagggattatattctttttgtgtacattatagtatctatgaaactaagacagtagttttgggggcttttaaaaaatgcttttgtatgacaaaacaaaaagaaatgtgtaatacttccccttttcaagcactactgtgctgcttggaaagtttcctactaacatgtatgattaatgtatactggaatattaaagaaaggggacgacacacggcacagagctggctttctgtagttctttaggtccccctcgcccccaccagatttctccctacctagtcatgccccaaaggtgctttcgaatgtcccatttctctcttactacaagaaacagatgccattaaccagttaaaagatagctctaatgctacacaatgaaaactcgccctctgaatccaaatgctgcttttctctttttctgtacaaaacacttatatcctgaaggttcctgagat

SEQ ID NO: 9312 - DNA, 1662 bp, artificial
  synthetic oligonucleotide
attgtttaataacttacttaacttaggctttatgctctctagatataaacaatgaattcttttccttttataaaaaaatatgctgcatgttttattaaaagaatatgcaatagttaccaatattaaaggttttaaaattcagaaatataatgccacagttaacaaagtatcaagtatttaaatgaggacttaatatattagaatgccatcactagtaaaatataagtatttaggtattaaaactgaatgaatattagaatttttgaactatataaactcagcattaatgctttgaaagagttattattcagcaacagatattgcagaacagacttcagacatagctctctaataagttcttaaagggattgtttgatattattatatagcacaaatgtgattcaataaatgtggcactacaaaatttcttaatactgaatgttttaaccttaaatattatataatggtacaaattaattttagtttcttgtaatattttcacatatacttttatgtgatacattagaacacattagctcatacagattgtaagataatcacacaaaatagtttctttttttaacctccatatttgaagaccaaactacactatatattatggcactgcttattttgacctagcacttcagctatattttctttggtaaacattttaatgattgtcatgttttcctcttataagataaatcacagatggttcattaataatatgtatgtgtttaagatttaatattactcaaaacacttctaggtcatattttgtcaagatgagattaaatcagttgcagaaaggaatgagctgtatcaagatcacatatagaatgaaaataaaacagaaaagtttggaatgtgaacaggaaaaaaatacaatcataaaagtactagttctaaaatgttctactattattatacaagacaataaatcaccatgctgaggatattttctttcatatgtatatcagcattctatttcctctgtgaaattctgcatactcgatgagtagtcatttagtacacagggacattaaaatattcatgacgtggctacaaaagaaatgcatatattcttacacacagtatacaaactgacacagacacaatcagatttctagaacatttagctcacagtaaagataactaaaacttaagtttctgtttgctttcattctttggtttaaggctgaatatttaacttctaaacaatgcccaagactttagattcatttttttctaactttactacatacagtgttcaaaatgatgacagacatcctccagaaattttacaaaatcctaaaacactatatttactactaatattatgaaaagattttcagtgtaagtcatctggtcaatactgagttgaccaaaaattcaattagaatattccccttccaccagtatttaaattcattagttcatttgtattacataaactaaagaacctagagaaaaatctttcccaataaaaactggaaaagtagtcactcatctggtattttaagtagcaatgaaggtttttaaccgtttacttatacctacaaaagcaaaaaatccaaagaatttgactgagactgaggatattacttttttaaaaatcctcaagacagattttaacgaactctccagatttgagtgtct

SEQ ID NO: 9313 - DNA, 1240 bp, artificial
  synthetic oligonucleotide
agctgggggctgtcgtgtacttttttaaatagtgtgttggaaagttctttatataggagtaaagtttatttttgtcatttccaggaatattagggtcattggtactaaatatgcctagtgttaaagcaatcctggtataaaaatctcaacagaatggtcagagaatagaacctaatgcagaaaaagcttcaggcaaaatattatacctagatttctgatcataaataagatgctctccagctttatcaattttttgtcgctttctttccattgacatatttgggatctagaattttggagtatgtgacatttttcaatttgagatttgggaataaggacttaaaacatacgtaaaatactgaaacgttaacgaaatttaagtaggaagaaagtttcctcaaaattggaatttctgcatgatatctgttaaggatgagagttctttcatgtgtagtcaataaaagaaatcatgcatgtggcccaggataatttcactttaaaaagttggatttgttccagactctaaatgcctgcttcaccctgaaaatgattgacctagaactatctactgatttcagtaacgccgagtaattatcattaaattcagtattttttaatacttttctaaatacagtcaagatatatgcaattaaatgtggtctgcaaagctgaaatcttaataaatcatggaggctaagaaagaaaaccaccatcttgagctcaggacaactgagatattgatgactttcccctcaaatgttaataggcagggtagaagggcaggaagtttttaaaccactgactggttcattatcctgataaatgtccatcttgaacttaaatttattagttttttttaatatatattgcctgattactatttatgtttcaaaaattccaactatacattgctagcagaaacccacaggcctgttttcagtgaatagctagctgcatgttggaggctttttaaacctataaacgtctttttttccagtagactagcaacttaatttgatggtagttcctgcctccttcttaaatagcccagttttagaatgtaacatttcctatctgtagtaataggaggtcccttaactatcatgattaccatagatttgatttgttgcataggttaggtagtacagtctgcaagtattagtccctttctgttgcatgtgctagcaccttcagttcacaagggggtaagaggaatccagttgatttgaaataccttttg

SEQ ID NO: 9314 - DNA, 3232 bp, artificial
  synthetic oligonucleotide
ggtggatcggcggaaggacgcggaacctggacaggtcggaaataaagccgggcgagcagctctgtgcgcgatgtgacttcatgagtggatgctgagaaaagcggcagagtacgactttaaccgcctagccacaacacgtcctgctagggcgaggagggagacagtgatacagcactgggcaagtgctgaagcgacaattacttctagggcggggtaaaagccccagagtatttttgctggaaggaggtatttatttgagcagggttctggaagacgagccgccgaagggtacctccggctttccgtttcaagtcccacgctggtggaggttgctcggtacccgcgcctgcgcgtgcccgtctcgactcttaggcccgccctttcctgccagacctggaggggcggggcggtgccggcaagatggctgcgcccgagaagatgacgtttcccgagaaaccaaggtaagcgccgtacggggagatgagcaggcgagcgggccgatcgtgggcatggaggatgtggtggcaggaagaaaagagaagctgggccaagctaagtgagccaccgcggcagctccattccttcctggtgcgcgctctggtgccctccccggacttgcacgggcggctgtggctcaggcaagcgaggagaggatcaggttggcggatggagaagaactgtctgggagtgggaggatgaggcgatgatagatggctgttctgtaattaaaatacaggaagcaaggtttctctcctcagcacccgaactatttcctttcattgggcacagaggagcggggagctcgggcagcgctgcattgtagccgctgatcgtcgtgtatatgtcttaatcttccagccacaaaaagtacagggccgccctgaagaaggagaaacgaaagaaacgtcggcaggaacttgctcgactgagagactcaggtgatggactctttattctgttttctgtgttgtgaaattgctctgtccactccagccctaacttgaagccccagtgtcagaaggaagtcaaatattgtgtcggaggaaaaatagctgtgacttctgcccccaagtagttatttagaaacacatgtcagaaacaatgttaacatactaaaggcaggaagaggaagtcttggtgaatgatcgcccactgattctgtgtaacttataaagtatctaatattacagttgcaagcttcatgaattacagcagctagcacagtccttgcacacgtagtaagtattcggtgaatgtttttcttcgtaaaaccagcaggagttgaaggtattaattagacgttttgcaagtttttctcaaacttgactaatatgagacccttggtttacccaaattattatgttattcaaatatatatcaacataatactagttatgaagctcatttatttatttttgagacagggtcttgttctgttgcccaggagggatgtgcacaaccacggctcacagcagcctccacctcccaggctcaagcagtcctcccacctcagcctccctagtagctgggactacaggcattcaccaccacacctggctaattttttcttttcttttctttttttttttttttttttttgagacggagtctcgctctgttgcccaggctggagtgcagtggcacgatcttggctcactgcagcctccgccccctgggttcaagcagttctcctgctgcagcctcccgagtagctgggattacaggcgtgcgcaaccacacccggctaatttttgtatttttagtagagatggggtgaaaccccatcatgttggccaggctggtttcgaacttctgacctcaggtgatccacccacctcagcctcccaaagtgctgggattaaaggcgtgagctaccgcccctggcccacctggctaatttttaaaattttcgtagagacgggatttcactgtgttgcctgggctggtctcgaactcctggcctcaagcaatccttccacctcggcctcccaaagtgctgggattataggcatgagccaccacacctgacctgaagccattgtttgactataaaacaatatatgggctgggcgcgtggtggctcatgcctgaaatcccagcactttggaaagccgaggcagatggatcacctgaggtcaggggttcgagacctgcctggccaacatgatgaaaccctgcctctactaaaaatacaagattagctgggcttggtggcaggtgcctgtaatcccagctactcaggaggctgaggcaagaggatcagttgaacctgggaggcagaggttgcagtgagccgagatcctgccactgcacttcagtttgggcaacagagtgagattctgtctcaaaaaacaaacaaacaaataaaaatacatttataaattataaaactaaatgaaattacacattcggtaaaatttaaatctacatcaggtaatgctagggatgatgtgaaactaatgctcctcacaatatgtatatggcactgatgggagtttggaatgcctctactaatgttgccttatagttatttaccactttttctatgaaattactgtagaacctttatttgtacagatggtcatttgaccttcacatggcaaaacctaacatttatgtattaaatctacctgcttaatgcaataaaattaggacttagttataaaattatgtagtagttataaatccagatgggagcactgaaatcacacagtagtactggcttataatgattgtcatccgcattatccagaatatgctcatgaaattatcctagacaattcttaaaatccagagaccatggcctcaagtaactaggattcttggaccttgagaaacatagccatagaggttttatttaccattggtgttcctgagtaattattttagtgtcagtactgggatatttagaatggaaggagcagtgtgtttaactgcaacctgtgttagcatttctgtcttattagttgaaaactcatccactagaggcagaacaaagcatcagggataaaaggaaaagtagaataggttggagttattgaggcccttattgtacttcgtctctccccccttgaaattttcagctactttactttgttcatttaatctgttttattctaaatattatatattctaaatttgttttaacttctttctctttttcttttcctgcactaaatcctataacagctggtatttgtattgttttgattttttttttcctttttactta

SEQ ID NO: 9315 - DNA, 1626 bp, artificial
  synthetic oligonucleotide
atgcacagcccaatagagtggtcacaagccacatgtggcaattgagcacttgaaatgtgtctactgcagttctggaaccatttttcattttatttaattttaatttcaatttaagaacttaaatgaagcagggggcacctttcactgcaggcatgctgaccttgtcagcaaacagcctgctgatttgttctctaatttaattcagtaatgtttataaaattataaattacaagtttaagtgtaatttcagtcatgcagtttgtttttatgtaatcaccaggtagttaattttaattcacattctgttacagtttctacagtgagatgtccattgtttgtaatattttcttacttgttgttctttagctaggcaaacatcataaggagctacagaaattagtggatactttgccgtcaattaagcataaggtactatttgttttccttaattacttgaaatatacttttatgtttcaatctcagagcggagacattaccaaggcactttgaattgggaagtttaattaggtgaactgtattcagccttagaagaaaacttgccatttatgattccaggggacagaagtcatcattctgtgggtaggcagtgagctttctggttttgctgcagtgccgctgaggacttggggactcaggaacatattgctgtcccctcctctgttcctgacaccggctccttctaagtccttgtgaacacacccagagcagccttctgttctgtagctgccatcccacaggcagggagcagagcgcagttctacagaaacttgccttgtccagctagaaagaacagtaatccacatccttcaggtcggatgcctttgtccagtcccccaatattaattcttcaatattcagaatctcaaagggctgctctctggaggcccatatattctcttcttctccctctcatcccccactgtatccctctggtccccacctctttccctctcctttcctctctggaagcccgtatattatctccccccatcccccactctgaccttctggtccctacctctttccctctcctctcatctccattttcctgtttttccctctctttccttttagttcaggtttctggctcctcctgagctgcatttcttcttaaaaggacaattctcagttagcctctcgaaaatgcaaagcctccaaccgggcgcagtggctcacgcctgtaatcacagcactttgggaggccgaggctggcggatcacgaggtcaggagatcgagactgtcctggctaacacagtgaaaccccatctctcctaaaaaatacaaaaaattcgccgggcatggtggcgggcgcctgtagtcccagctacttgggaggctgaggcaggagaatggcgtgaacccgggaggcggagcttgcagtgagccgagattgcaccactgcactctagcctgggcgacagagcgagactctgtctcaaaaaaaaaaaaaaaaaaagaaaaaagaaaagaaaatgcaaagcctctttctttatgcactggccgctgtctaaaacctctcaacaaaactcagaggagactacctgctggaacctcactagaattgagagatcaagtggttttggccgttttcccacaggggaata

SEQ ID NO: 9316 - DNA, 1348 bp, artificial
  synthetic oligonucleotide
agattttttgataatttattgtgtaaagaaatgtactaaatactataaaagtggcttcctatgtttactacccccaaatattcctactaatgacctgagattaccaactccttttccacctattaaccttttgccacatcttccccaattttctcatccaaacccaagttggggcaacttcagactgtaagcttcttgaggcttgtcttgtttgtcaggggagcatgtactcaataaatgaaatttgcatgaatgagtcagagatttatgtacacaggggaagaaagctggttatagcttcttcatatttttcacgtggacccagagttgtaaattgagggaagaaggatagcagagtaatctcaaagcacaaagtgggggtgatgtcttcacacgccctcagcagcaacggggcactgggtgcttaggaaagcccatctgaaggagacatcaggaagtagaggaattctgttttttccactcatctgcctagtatttaaggtcggctaagaggctagaaggaacacatccacagttctgctttagaggatatgaaaattgggctggaaggaacacgggtccacagttcgagttcagaggacataaaaactggctcaaagaaactcgggtaaattggacatgaaaactagcgggaaaggacacgttcagtgtttgtttccctactgagtcacctgttcccagcacataaagtcgtggtgtttggagatgggaggaaccgagggaaagtcactttttagataaggctctgaagccccaggtctagtttcaatccactaatgcggccagcggcgagcaggaggagggaggattggtccggcgggggcggggccagagcagggctcagaggcgtggcccaggctagagggaagagcccagggggagcgcagaggcggggctaggagggagcaggggtgaatgggggcgtggcccgggcgagaggggcgtggctgtagctaaaggggtgtggccagggtggagggcagagactggcacagtttggttgggcgtgaccggggcaataagtacggacgtagtggggcgtggatctgccaggtgggggcgtggcctccattgaggggcgtggccctggtatgtggggcgtaacagggcacgagggggcgtagcttcgatggccggacgtgcaggctgcggatccccgtaggcgagcgagcggctaggttcgtgatctggagagacgctcaggtaaggacgggtggccgagaggagtggggggcgaccagggacaggccgatccagacagggccgtgattcttcccacgactctccgctctggcgcaccgggttccggagctaggagagctgttga

SEQ ID NO: 9317 - DNA, 4034 bp, artificial
  synthetic oligonucleotide
acactcaggtgctccacttactgctttatctcccagagctgttctgatactaagtctcactttaaaagcattttctgcacctgccagaaaagaaaaaagaaagagcagtatatgatgattaggatctgccaaaacagagtctgaaaaatcctaatatgtaatgcaactcaaactaatggaacaaagaactacaattaaacagccccaaatactcctggaagtttaacctaaatcatcttagatggtttaatattttctttcaaactcattaaacactcactgccccaactttcaagccacaacatgtctgcagatttagaaaaataaagagttctttcagtcgatgacttgtcaaacatgtagaaaactgttcatctatttttaaatttcaaggctacatacctggttgacagagttcagcatgaatggcagtcaccagaaaaaagagcagccacaacattctttcagggtggaaaacacaaggcaaagtgagaaaaaaaaaatccacgctgcacttaaatctgccttagccattctgtgacccggattagaatatcagagaaacaagcgagccaccaccaaaaaggtttaatgattaacacccatcatttgggttaatacttccataaaaacagcccatctcctgtcagttatttatgaaaacctgtttggaaaacagattagttgttttccctactctgactctacctcaaaagaatgtcttctttgctgactcaaagttggaatcctccccgaccccttctgcgattctctggttacgtgtatgatgggaagaattgagtcctgtctagaggtttccttgacatgcacttcccaccttttcgaggctgagatacctggttcttagataggctatcttcattcaggaaacaaacgtgactcccttctctctggtaaacaaagggtgccctccgtgaagggcctcacctgactctcaccacagcgggtgaacatcccaggagagcttcggagcttcctcttacctacttaaggttagagggtgggaggagagagaggatcgaaaaactacctatcgaatactatgcttattatctgggtgacaaaataatctgtacaccaaactccagtgacacacaatttacctatacaacaaaactgcacaggtgcctgcacattcacacatagggaatgattgtgttcagccctgaggtctggcacttgaattaaatcaaagttaatgatacagagcagcactgtccaagggacattctgtggcgatgggaatgttctgtgtctgtactatccaatatggcagctactacaggtaggaggccattgagcactggaaatggagctagtgtagctgagaaatggaatttttgtttaatttaatttaagtaggcacatgtggctactgactacattggtcagtacagcaatacaacagtaattaaaagttacccactctgaagtaccttcactgggttatttctctgatcctcagacacttcacaattgttatcatcatctcatacgggagggaactgaggctccagcgttgaagtcattggcagcaatgggatgagtgggatgggtgtcactttaccagctaggttgacttacacttgaaccctgtctccaccacacccaactgctctgtgtctctggtcaccattggtcaaaattggaattgatcaaataccacagtctcactgataagtgggagctaaacattgagtacacatggacacaaagaagggaacaacagacacaggtacctacttgaggatagtgggtgggaggagggagaggatcgaaaaactacctatcgaatactatgcttattatctgggtgacaaaataatctgtacaccaaactccagtgacatacaatttacttatataacaaacctgcacatccacccctaaacctaaaataaaagttttaaaaaaccctgaagttgcaacaaagcctcagagatgctctgagaattaagataatgcgtgtaaaagaatctttccccggtgggcattccacagatgccaatcaacgccccgcccagaggttgatgtcaggactttcctctctaccatgctgcctcttcataaattcagtccccaaattccaccccattcctcaaaagtcatgaatggcagaattagattgggtgactctggtgttaaatagaaacattggattttcaaagcaacaacgaggaaaatatcaacaatgagacttctgcagcactttgagaaacacatcatttctccctccttgcgagggtggtattttattgtaaaggacccacatccatcagctaaatccaactgagaaagctttttctcatctccttcaccttggttgcaaggacacggagtcaggaaaagctgtactaaaaggagagggagccacaacttagtccagccatcctagcaatgtcactgtattaggtgcagtggaaatttccagaaggaagagctcacctagctaacatctgaaaaaaataaagccagactagatgaagtcatcttgggaaatgttaaactagataaagtcatcatgggaaggaaaagtcaatacacatagagattgtaacaaagcattttacttacatcaaggaagaaagctatgctaagaacatagaaatctgcttcagcggctgggcacagtgcctcacacctgtaatcccagcactttcggaggccgaggcaggtggatcatgaggtcaggagttcaagaccagcctggccaagatggtgaaaccccatctctactaaaagtacaaataattagccgggcgtggtggcaggtgcctgtagtcccagctactcgggaggctgaggcaggagaattgcttgaacccgggaggcggagcttgcagtgagccgagatcgtgccactgcactccagccggggcaacagagcgagactccatctcaaaaataaataaataaataaataaataaataaataagaaatctgcttcagctttcctttagccttacacttcataaaagtatcaagtggctttctttggcttttacttagtcattgatgtaactcgggttgaagacaatagaacactgagtcttagtgtaagtcattcatttgagaagacaatctcttttgaatgatggtttctcaatgtttgttgtatcatcttttcaaaaagagcaatagaaattctttttagaaaatacaaagcagcacaaggagaaaagtaaaaatcacctgtaattccatcagcgtcaacgaatgaccaattgtcaatgttttctaaatatttggaacatatctttctgccttgtgctttcttttttgtgtaaatacatgtacatttcttcttaaaaacaaaactggggtcatgctattatgcagctttgtcatctttgttgaacttaactgtgttttgttgttgtttgttgtttttttttaatagagacaggatcttgctctgatgcccaggctggagtgcagtggcaccatcttagctcagtgcagcctcaacctcctgggctcaagcaaccctcctgcctcagctcccagagtagaaacacagaattcttcttcaggttcctttagtcttgcatttcttaaaagtgacaaatttcttcataagcttttagtcatctatgtaactagaattgaagacagtaaaatattgagtttcagtcagtgtaagccattcatctgaaaagggaagacaatctcttatttcattatgatttctcaatatttgtgttctcatttttaaaatgattgaaaaaagcaatagaaattctgtatagacaatatagagaagcaaaaaaaagtagaaaacatccataatactaccagaatggatgaccaatgctaatatattttcatagttagaatgcgccttccttagccttggatctctttatatgttcttgtaggatgttgttttttctcactgcagtggcactatcagaacagagtaatacaatgatgggaataagacgcacccttgtcttcttctttactctaataggaatgccactactgcacggaatctggcaagtggctttaa

SEQ ID NO: 9318 - DNA, 646 bp, artificial
  synthetic oligonucleotide
ggctggtggaattatttgaattcactttaataatcattttgaccaattgtttttaccaagaaattatattaattcatacataagtaacttctttcagcaaatcatgaaagagaggtaaaaatgtttactccttttcctcaagtgtggaaagccctggtctgaaggtttctctaagaattggatccactgccatttttcatcaatggcgccagacagggccaactgcctccaaagagtggtaagaatctggctcttgtttctggaaatcaaaaggactaaataggcgctgggctgctgttttacaagcacaagaccgttaatccccttaccgtggatacaacagcacgttgttcctttttagatcacaagacttatccttgaataattaggcagaggcagaaatccattatatattctacaccatttaactcagaaagagaaagccttgcctgagttagactttatctttcttgctaaaaatgataaattatctaaaagttgatgtttgagtaaactaggcatattaagtttccagttgacctgggaattagactaaactttggattagattatagcttccttagaaattcctttcaacattttaaaattcctgtgaaactgttttagtaaatctggcctaaatcat

SEQ ID NO: 9319 - DNA, 1062 bp, artificial
  synthetic oligonucleotide
tacttaagagcaaaattgcaaaaagcaacattaacatccatcctagaagaatctgatatgagtaaaggatttgtttagagcatccaagtgtattgtgatcattttcacactgatcaaagagagcacccttctgtcaacaggtatctgcagttttcaggacctggcagaaattcttctatgttctgtttttaaaggtcaggtacaaaagtagaggcagctgccaggcccctctgcccagagctgagtgtctgggaccatgagtgggaaggactgaggcttgagcctccttggtccgccagacagcatggggcgccacttgccccttctgcagctgcgcgccgcaaagctctggcctggccgtggcctcctgccccatgcaacacttggtggccagaccgtacccggcacatggcgcctcgtgcactttctgacattttgataccaaaggtcgctggtcactgagcccggacactatctctggccctgaccgcagatttcggaaacttctggcagcccagtgtctactggaaggcccaacccactgccctgctctcatgggcagctacctgagcggcttcctgggctggctctgggccagaaaaccgcgcacccacccccccgcccgacccccgcgccagaagcactgggccctactgtccaggcccttcctcagctcccaggtccaggagaactgcaaggtcacctacttccacgggaagcgctgggtctgcatccagcccctccccaccgctcctcccagctgggactacgcccgcatccgcatccggagagagatggtgcccgcccgcatccgcgtcctgagagagatggttcccgaggcctggaggtgctttcccaacaggctgccgctgctgagcaacatcaggcctgatttctctgaggctcgcctggcctacatgaagcggtggctttggaccgccgccacccccccaccagcctgtccgcagcctggtaaccatgaaaatcgccccgcccgagcgcagagggagcccgatgcccaggccatctgccttcgggtctgtgatgagaaacggagtggcc

SEQ ID NO: 9320 - DNA, 2032 bp, artificial
  synthetic oligonucleotide
gtactgttcatccaacttctctttatgtatgacaacttttataatgaaaaatagtagggggttcacaggggttgagaaaagattgtgtggggcctggttaccatttaaagacttcggcttctaccctgggagagatgaggagatatggagaagtttgagtaaaggaatgatatggtctggttttctgttttaacatatgtcagggctttctttctctacttaaacctggctcaataccaggaggatgaggagtgttgtagttctcgacatagtcttgccagagtctctgaaatatgtcctgcattactcacaagaaaagcataaacagccgggcacagtggctcacgcctgtaagcccagcactttggcaggccaaggtgggtggatcacctgaggtcgggagttcaagaccagcccggccaacatggtgaaactccatctctactaaaaatacaaaaattagccaggcatagtggcatgtgcctgtaatcccagctactcaggaggctgaggcaggagaatcacttgaacccgagaagcggaggttgcagtgagctgagattgcgccattgcactctagcctgggcaaccagagcgaaactctgactcaaataaaaaatgaaagaaaagaaaaaaagaaaagaaaagcataaacaagaaatggcttcaatcaaggtatagcacaggaatagccaacaaacaattgaccagagtgctatgtaaatgctaaggcacaactataatctgcattttaaaatgtccagttgtgaaatacacccaaattgtctaagattctgatttctctctatgccactgcccatggttctgtgtttggtttggatcaatactcactctggcaaccacactgcacattattcagtcatgagtttgcagacattccaatcccagttcttattctccattgagtatacacctggtatggtgaagatgatatcttcaagttattccaggaagaggagttgatgactgccttagtccattttgtatgtctataaaggaatacctgaggcggggtaatttataaagaaaagaggttttgttggctcatggttctgcagactatgcaagcatggcaacagcatctgcttctggccaggatctcaggaagtaaaagctttttggatcccgacccaaatggtggaaggggaagggtgagcaggagtgtcacatggcaagagagggagcaagaaagaggaggaggagaggtgccaggctctttttaataaccagatcttgcgtgaattcactaccatgcgggaaggcaccaagccattcatgagggatctgaccccatgacccaaacacctcctactaagccccacttccaacattgaggatcatacttcaacatgatatttggaagggacaagcatccaaatcatgtcaatgacaaagtattttttaaatgggcataaggtaaaaatagaacaataataatttaaaatagaaacaaaaacaatcaatcactatgaatcctataacacaacctatgaacatttttaaatgctgtatgatttcaggcaacatatttaaatttgcttagcctctgtttcttcttttgttgaatgcaattagtaatacttgccttatccctttggatggagatccaaagagatatgatatccatccaaagggataaggcaagtattactaattgtagttagagttaaatgaaataatgaaaaacagtaagaattaatgaataaaatgagacctgtgaacaatacaaagtaatattgaaactactcaagtccacaaactaaaggaaaaaaaagatttatttaggaaacatattttactttatatataaatattcatatcctcaatgactaaaccttggaagttagataacctatccatctggaaagacacatagatctcgcaggaaggtggtagaagggaatacgtagatttatcaggtatctatttgaattcttagcacaaagataaaaagaactatgaaactatgaaaaaaactgccaagtacattgatttctaaccccccacaata

SEQ ID NO: 9321 - DNA, 1562 bp, artificial
  synthetic oligonucleotide
tttttttcatgacaccaccatctgctacacggtactcataattacatgttttactaatgtattcctttattatctgtctctccccactaaaatataagctccaagagggcagaaacttttctctattttgttcactgctatatcttcagctgcttagaaaagtggctggtgcattataggtacacacaataaatatttattgaatacagacattgttcagcaactcagtagtaaggaggaagaagagggaaagctcagttgtctaccctgtgtgtagcataattcattttcatatggcatatttcatctgtttatttgcccatccacagaatgtgatggatagagattagtatcaactgaaaaaaaggtggaaaaattttctggaacaaaatgagatttggaagctatgattcaagttactatggtaaaagacgtgagagaaaaacagcatgattactgtaagtcaggcattgggctaaatgccttacatatgttgtcactgaatccaccaaatgaccctgtaaaaatggtattgttactaccttctcatagatgaagaaaatgaaaggcccaggcgcggtggctcaggcctgtaatcccagcactttgggaggctgaggagggtggatcacctgaggtcaggagtttgagaccagcctggacaatgtggtgaaaccctgtctctactaaacatacaaaaattagccgggcatggtggtgtgcgcccgtagttccagctactcaggaggctgaggcagaagaatcgcttgtacccaggaggtggaggttacagtgagccaagatagtgccactggactccagcctgggtggcagagcgagactccatctcaaaaaaaaagcgggggtggtgagagcataaatgaagtttacctcaatcaagctgcttcttctcgcaaggtcatactattatttactaagtagccaagccaagtgttgaacactggttagtcttttccctgagccagatatctcagcccacagttaatgttttaggcaacaagagaaatgaggaccctccagcattgtatgaaaagaaccatatttatgttgcaactaccatgatgccaaagctcactgatgactgaaagtgggtgtcaaggaatgaggtcacagcaatggaaatccctccagttggtttcactaataatttttattttataaaaatgtattctgaaatttattcacctactttttattttaatatgacattaattcttcactcctacccaatgctggcccatctgtggccataaactagaactgattttcccatagttgtggttatcagaatccctagatggtgagattgttctaattgggatatcaaagtggaatattccataaaataatagtattctaggatataaatataaaatggcatataaaaataagtattgtagatcaagattcaggacatgtaaacactctttaaagtgggtcagcaaaacatagggctggtaattctagcactgctaatttattccacaatctggagggctctgaactcaagaggttagaatgctatcaagagtccatgccat

SEQ ID NO: 9322 - DNA, 1605 bp, artificial
  synthetic oligonucleotide
tgccatgtatctttctgtatgtggagaaggaatagcccagttaagtttccccactgtcgactagcacaaagtactataagcacataataaatatatatggagtaattgaaataaccagatctaccaaaacccaaagaagttttcttatccacacatacacagagaggtgcattttttgtttcattcagcatttattgaacctggaatatgtcctacactctgacaattctgaagtgaacaagtcaaagaccataaagtcataggacagtgaggcagccatgaaatcaataactattaatacataacagaatgacaagtgctataactgtcaccaaaaagtgatgcggtagtataggagcagggagaaattaataactaataaccaggagattcaagaatgggtccaaagagaagggaagataagagctgtgtcttggagaagaagtaggcactggtcatgtagagaagggaggtagagggaagagtctaaaagatggaaggaggttggaaaagacaaggcattctcaggggacagtgagatgttgaatgaaactggagcaatggtgttcattaggggaaatgaaagacatgagaatggagagacaagcaggggccagatcacgagggaccgtctatgccataccaaagtttttaaactttaccctgcagataaagtgaaggtgatatagtgaagcagtgctactccaggtgtaatccgtggaccagtgcaagtgacagtttgtttccattctgtgataagtacaggaattaagagaataaaagtttataaactttggagaacaatttgatatttccatgacatctaagcatgtaatcaatgaacttaagcaagtattgatctgcaatgtattggaaataaaggaataaaggagggagaaaggaaagacgggagggaggagagaaggagggaaggaagaagagaagaaaggaaggaaggaaggaaggaaatggttctctccctcagattgatttaagaagcactggattaaaggatctgtttctccttctcctatttccctttggttctgccttgagagtcatcctaaaacatgaaatagatcctatgtttaaaacttccacacgatcccatagtccaaaggaacaaacctaaattccttaccatggcacaaaacccctcatggtctctctccagctcttcttcaatctccacggcttcctctccatcaaatctaagcaaccttgagtccctcctcttcccaaacactttaagctcttacatgcatttcagtggttttcagtcctggctacacattagaattatctggggattttttaaaaaatagaatttctaggttccacctaggctagaccagattgtctatatgcgaatgggcaaggtttcttatagtgtccttgttgggggaaaaaatggagaaacatagaatggataaagtaaagtgcattgataattagttggataattggacccaaagaatgcagaaaaataaatgttaacttgtagaaagatacatttcacatggttttatctttgcctttttgatgcatttttatttttatattcacagattagaacatacaaagttccagaggacaagcaactga

SEQ ID NO: 9323 - DNA, 1219 bp, artificial
  synthetic oligonucleotide
ttggcaattaatgatcaggaagatgaggagagaaataaatatttggatgaaaggacatgcaggatattgttttaaaaatggtgataagctattgtctccagcttgcctaaggcttaagaatactgaatttaagtggcagtgaaagaaatgttaaaacaacaaatgcgggaaaaaaattcttccttactcaacctcagtgggcagtaaatcatcaaagcaaaatgtgaatcatgattccatgacttcagctcactattcagggaagagaataagttaagagatatggaaattccttcctatgttaagattttttatgaccacataatctgagatataattacaactgcagaaaataatacatttccagcctaaactaatctgatattttttctttctggggtatcaccctaaggtagacacacaaatgacctttgaaagtgaactgtgggggctttagacaaaaggcagtgactctgtctttcatcctgagaaatgggattcccccccttaatccccagactccctcgggaacttttaggggcctgagatcttcctagattacttataattcataattcctggataatttactttaggccttgtagttgagtctcattcttgagcttcttgaattgtagaatgccagtgcaccttttctttttccccagtaatttcttttgaaaacaggtaatctgaattgttgaggacatgattgttaattgaggggtatccctgatatcaaagggcaggcttggtaatgcagaagaaatagccccgtggccacacagagagcttcaggacctctacagatcagcaaacttacgatttgctcttgccatctcatttttcaagaccacatactcttcatataatggcctcagctgcttgccgacctcagatctccagctttcccaagcccagagcctctcattgtagtctaaactgtttgccattatttcattcaaacctgttatcccaaagcacacaaagacaagaaaagatgcctttgtaaaaattttatttgtaaagaactacatgaactttaaagaattaaaagtaaggttggcagacatcaggtcataaagtggttaaataaaatctcatgattcattcatgtccttgcccttatagttccaaaatatgtctgcagagaaaataaaccactgaaatgacttacttactgacttgatcaaattaagtaaatgtgatacaatttaca

SEQ ID NO: 9324 - DNA, 760 bp, artificial
  synthetic oligonucleotide
tgtgtgcctctgtgtgtgtgtgtacacgccagtcaaatgcttttaaatacacagcaaactcattagaaaacattttactgattgcatattcattgacttacttcatctcccaccactttttcatccactggtctttgggaatttcccctttaaagaccatccacctccacttctctaacatgtaagtaaatggcagagtcccaacaatcgtgagtgcttgtttgagcaggaagtttatttctgtttctgaaagtaaaatagaaaaggataaatattacgatgaagatgacagtggatgttttgtgttaaagagaattttcctaacctcaaaatattattcctcaagatgtacttactataaggatacatgagaaaaattgacagtattcataatgatatgtatatatttattttctcagctaagggatttggagtaggttgaagccctggaacagaacaggtaaataaaacccaaagttacttctaatcctcattttcttcattagtttcagtttcctcccttaaatacctcttatcagagttcattagagctatttcatccactttcccagtcacactgtttattctggaaagctccatgaagtcagtgactgttaatgtctcatttaagactgtataacttagtcccatgtctgctacgtgatgccttctgtgagtctttgttaaataaacaaatactaaacagattcagtgaaaagcctgtaaaccagggaggggaaatgaaacaaaagagccctcc

SEQ ID NO: 9325 - DNA, 1481 bp, artificial
  synthetic oligonucleotide
ataagggttggggcaggggctcactacacaggtagttgtcactgtgaggctgacaactcacacttcacaggactagcgcaagaattgtgtcttggccccaagaggttcctctgtggctgcccttgccattcacccactttccagcaagcacagatgtacaggtatcagggaacatggggaagaaaccccaggctccagaagcaatggcacaggctcaccttccaagctctgctcatttcgctgggactcatttcccagggatccctcactctgacccatagccttcctgacctgttgtgtgaaactcactccacaaaccctgtactttctgataacagctctcttccttttttatctgggccacctcttggtgtggtgcagggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgaggcaagtgtattctctgggtgggctggaaggggtctcaggcacatccggggtgattactgcatcaccactgggacaaagcttttttgagggaaagcaactggtacagagcaggagagaatggtcctcagcccctgccctaaaatgtttgtaatctaaaacatgcgggtgccaaacaatttactgaacaacttacatacagcagtgttctaagaacactataaatattaacttacttatgcatcaggaaacacactgaggtaagtactatcattgctgaaactaacagaagagtaaacaaggactcagaaaggttaagtgacttgtccaaggtcacatagctagtaagaagtagactagctagtgccagcgtccctgttcttaactgcaacactatggagctcctcgagtagaaaataagtagcagaaaacatctaaccacacgtagagaacacataatggacactatcccatcttctctccccctgcctcccaaacactgaataaaagcattccatgcaggtagaagataagggtatcttatggggaagacatggagctgaagcttcaggggattaatttgcaaagcatccactaagttcatagaactaatggaggttgttaaggaagtatgaggctccatttgtgccctcactgaactcaaagtctttacacacacacacacacacacacacacacacacacacacacacacacaaataggactgaaaacaccaagcagtttataattatgtgcccaaattagaaagacaaggtttttgccataactttcaatggcaaaaaacgtgattacttttgcaccaacctaatacaagaagcgctcagaggaaagagaaaccagcttcctgagagaaagcagcttcttgaatgcattggtacctgagctgaagcaggaaatctctacaaaatttcctaagtatgtga

SEQ ID NO: 9326 - DNA, 149 bp, artificial
  synthetic oligonucleotide
caggcctcagcaaaattatgacacaggcaacgtttgtatgtgtgtgggaggtataatgtatagggtacataggttatatcaccttgcctctccaggcctctctcctgattcttgattttcttccttctattcccctgtaggtatatatc

SEQ ID NO: 9327 - DNA, 163 bp, artificial
  synthetic oligonucleotide
agatcagcattttcaagaattttaattgtagtcacaatagctaagaggaaaataagttattttaaaatatataagtgacagaatgcttgcatatatataagaaaatcagggcaaatccagtcaagatgatttattaatctagattttccattgtttaagataa

SEQ ID NO: 9328 - DNA, 3563 bp, artificial
  synthetic oligonucleotide
tgcttgtaaaacatttttttaggtaaccctcttgacaactctattgaaaggggtaatattattctccatttttcagacaagtaaagtttttaaaacatggccactgtcatagatacagtaacgagggactcagaactcaattacctaaacctgattttttaaccaatacattgtaaatgctaggcaaaactgaagatttaatgaagcttttattcagtgatgtttaggccgccctggtaacaacttttggtagaagggagagaatcattgttaatgatttggcactatagtatttccctctgtgatattttcaagatgggtaaaggtgtgaagacaatatttaactcaaatgaatggctccatttgtgaaatttcaggtattatgctcctagatggaggaagattttattttattttattttattttacttaagttttaggttatggttctttcttagtacacctcaaattacacacagttactccactttgatgcaaatacacccttctcacacatagggcttaatttttcctttgcataaaaaggtttagcaacccattctgcgggtagcaagtggtccactgggggacagaagcttccctctacccaccaccagctcattgaaatgagaaagacaacccctctagagttagacacacctgcagcaaagtgctgctttgctgtgtcacctaataaaatcatctaccatctctgggtttaagttaatcctgacctgtcaaataggagatcacatttcttttctcctagagcagtcacgagccacagatgagacactcataaatatattaaaatatcttatgcacaaacatgagtcactgtggttactgtagggcttctaggaggagctctaagattctgcttcccatttagtctcctttggtggaatttcctgagcggtaggtgctatgtcctatgtacagctcttggtcatgccctgctagatctcatgtgtctgagcagctcatgtgaagacatacgaaatgtaaaggaagagcagagaaagaagcaaaaacacatctcctagcccctcataaaactgcagagagtccccatcactacagctgccatatgcacaataagtggtttgtctctatgcacagtaagtggtttgtatcagttagtgatgttttgggctgcaggtaaaaagacatcaaacagttgctgaaacaaatccacttttgttcttctctcacagtaacaaatgcaaagataggcagtcagtcaagggctagtgcagcaactcagtgaagtcagtagggatgcaggctcctcctagctttctgctctgttatccttagaagctgcaggagagattccaagccttcccagaagcctccctgcaaacttgtgcttatgtcacatcatccagaactatatctgatggccattgatgtgtacaaaggaggcaagaagacagtatcttttttttccagtctctgtgctggaagatagtgagaaagaaggtgcatgggatttgctgtcaagttggccaaccaacctgctgcaggaaaacaaagaggttctcctgctcaaatattctcccctacaaagtttcattgtgctataatggctcctcctgccttttgtgtctattatttggctcaagcattataaactgaggtagacatttaagatagaattttccagatgttaacctacacttggaaggtttgggctgattcagtggtagcataggagtgtgtgtcaattatcatggttctgaattcagctaaccagatgtggaaaaaatgtgctcttccttccaaaaattaaaacagaagggggttttgcagaggagttggcacctgtacatcataatgtagtagaaaaagcctgaggctgagtctcaggtctgctatttattaagcttgtgaagttgagcaattgtactacctctctgcacttcagtttacctaactctgtgagaggtgtaataacaatagctacccctcaggttcttgaattgattaaattagaggacatatgtaaaggaaaatacataaatgtaaagtcctatggatatatgaatatatgagttcctcttattgtcgttattaggtggtgagactgttgcaatgtagacttttggatttggttggaaaaagaattagttacccaggaaaccaaatccatgtagtaaggaaataataggaatcccaacatgtggaggccagaagcttagagagcaggaaggcaagtaatgtgcccaagagattgcaatggccatttggaaccaaaatcagaaacttacgttttataattttaactctttttgccttttgtgatttctgtcataatttccctttaattctcattagtaaagttttttaatgccagcattttcagctaaactgagctaagttaaattaagggaatgatatcactaaagcccactgtttattgaacacctacttactctgggccaaacactgctgggtgctttacatacattatctaacagcctcccaatgacccagcaaagtaattattatctccatacgcttccttgagtcaggactgtaaggataagcataactctcctgggatcaacataaggaaatctcaagatgaacataaggtcaagagagaaagagttaaaggcacatatagaaccagcccttctcacctagatactcttcttaaaatatactaagatcttgtaggtttctctgttgtatttcaaaagaggctaatttgttatagattacagtttcatttatttgaattatacattgccctattcccgtggctttttaaaatatgcacatattcctaggaaagtagccccataaaccattcattccttagtataaacatgtcaaagtcacagaagtcaaggaagggatgagaagcagttctaaattaagggaaactaagtgccatgtttgattttgaattggatccttgatcagaaaaaaagtgagtgattataaaggccattattggaataattagaaaaattttaaagatgaaatatattttaaataataaatgcagccataaaaaagaatgagttcatgtcctttgcagggacatggatgaagctggaagccatcattctcagcaaactaacacaggaacagaaaaccaatcaccgcatgttctcactgataagtgacagttgaacaatgagaacacatggacacagggaggggaacatcacacaccagggcctgttgggggatgaggggcaaggggtgggagagcattaggacagatacctaatgcatggggggcttaaaacctagatgatgggttgatgggtgcagcaaaccaccatggcacatgtatccctatgtaacaaacctgcacattctgcacatgtatcccagaacttaaagtaaaataaaaattaaaaaattttaaaaattaataataataataatattgtatcagtgttaaatttcctgagtttgataatcgtattacagttatataagggaacatccttgttaatataagctatgtgctgaagcatttatggatgacattatttaggtcataccatctactacttcctcataaattattaagcacaata

SEQ ID NO: 9329 - DNA, 1111 bp, artificial
  synthetic oligonucleotide
tgggcaatttatttatctattgcagctccataagctataagcagggaatgatgttacaacttactctatagggtgaatgtgtcacaacctatcccatgggctgggagtatcacaaaatatcccatagggtgggggtgttctggcctaccccataaggtggaggtgtcatgagctaccccatagagcagttgtgaccagtaaactctaaacagcctggcacatagtgagccctccttaagcattggctaggatcattatcataaaatcactctcatccttcaaagtctaatttcaatgtgctcccttctaaaataccttacttggctaccttaaggaaaaaacaacttttccttccttggacctttcatagcaaagtgaatagactctactctagcacctacatttttttccccatcttttcttttttaaaacatagttggtacccacaatgtgccaaatactttcaccataaggtttctcatttaagtcccgtaaagtaagagagttgttacctatctcaatttacagatcagaaaactgaaggttagtgcagggaaggggcttggccagggtgacacagtttacaaatgacagttctgtaacctcctccatgccttccgagtctgccaccccacagcaatctttcatattaattagttatgcagcccatctctcaaacttgttcattgtcactcagggccacggacagctgatctttatttctggaaccagtcactcaatgttggacacactgtaggctcaaaatcaagcatgccaaatagaactgccgacttgaacttcttactctcatgacatcatttccttataaatcctaaaaaactatagtgattataagtcatgttaattcaacacacaccttttatgtatgtaagaggttaacgaatggctgctggcttccttataggaaatactatattgatttctgccaggtttttgtgtctcctctgtgccttaatcactttctagtttcatctgtttatggaaataggcagcctgggctatttggtaagcaaattgataggtctattctatgtgggtggtaatatgagagtccacccagatcccactagctcttctatggaaatagatt

SEQ ID NO: 9330 - DNA, 1642 bp, artificial
  synthetic oligonucleotide
ggtaactatgtgaggtaatggataccttagcttgattgtggtaatcattccacaatgtatacatacatcaaatcatcacgttgtacaccttgaatataaacaatttttatttgccaactgtacctcaatgaagcttgaaaaaaaggaaaaagaaaaagtgttattgggtagctgtgaagacgtgtttgctttttccacagaaaatttgttgaggaaagtgtcaggagcaactaagaggagtaaactgagataaagaatctctgtgactgggccacattagccatacaatgtctttgacagaatctcacctaggtgccccttcctcctagcagatgcatccctgagcctgccagagctcacagctgagtgaaaagagccgccactcaccccttcagcccagcagatgatggtcctggcatggtgggccctggagattggggtgaaagagagacagctcctgttgaaccagcagggtccctgttaccaaggcttgttcacacaggtgtgtgggatggcatatgtgaggtctccacaccaccaaaaagctgcctcaggaaatccaaaggaaacatatttctgacaccaagcacacaaactcactaggtgctcaataaatgtttataaaatatgttaaatgaattcatagaaaataagtcaacttttccagggacatgtccatactaaatctaaaaatggaaagaaattctatgctgcccaatagagtagccactagcgacatgcagctatttaagtttaaattaattaaaattaaataaaattggctgggtgcggtggctcacacctgtaatcccagcactttgggaggccaaggtgggcggatcgcctgaggtcaggagttcaagaccagcctggccaacatggtgaaaccctgtctctactaaaactacaaaaaaattagccgggtgtggtggcaggcgcctgtaatcccagctactggggaggctgaagcaggagaatcacttcaactcgggaggcagaggttgcagtgagccgagatcgcaccattgcactccagcctgggcaacaagactgagacttcatctcaaaaaaataaataaataaataaaacaaaaacaaaaaaaattaaataaaatttaaaattcagcacctcaggtgcacctgccacattttgggtgctcaaaagccccatccggctaatggctatcatattgggtagtgcagattatagaacatttccatctttacagaaaattccctttgatagcacaggtttagatagaatgaatttgaaaatcagtagtcaactatggtaggcattttgtgtagatagaaaaaccttcccaggactttctgcaatcacagtaccttttggtagaacaagacttgcatcaactctaaaaagcagaagaaaagtaaacccttcttatttcattattctactaaagggaaaaatcaagcaactctaaacttctcattttaaggctatagtgattactctagcaaataaagattaaaagataccaaataattagtaagaatttaaaattacctcaggaacacggcaacattgttatttgaaatatataatttagcacttaaagcgtaaaatgttgtgtgtcaggacatgggctctttttgtgtaatctatttggattcgaca

SEQ ID NO: 9331 - DNA, 1968 bp, artificial
  synthetic oligonucleotide
cttcaggctgagatccaaacaaggagtaagaattagccaggggaaggggaagaggaagaggattccacagagaaacaacagcatgtgaaaaagaatctgagacaagaatgagcattattagttgaaggatctgaaaggaggccagtgcatactttaaagatttttttcttccatgaagtctagatttccctctactcccatttgaaaaggcttgttaaaccttctaatgtaggagttggcaaactacagcctgggggcccaatctaacctgccacctgtttttgtaaaagtttattggcacacggccatgcccattcattgacatactgtctatgtctgctttcatgctgcaatgacagagtctggtagtggcaacagaggccatatggtccccaaagcccatttgccctttatagaaaaaatttgttgaccctgctctaatgcagtataaggtatacctaaacaccctcttatgctgcatttcttctgtctaatgatagttattggtgtccctcaaagacatcctcccatttttaagcattttccttttccctttaaagttcatttcttcatattttcaataccttggttatcctttttagatatgagctagtttggcaatactttacctaaaatggcctatatattggatctggaaggggagaatggggttctctttccatcctcatcatttactagctctgaggctatgggcatctgtttttaaaaacatctttaaatccccatttcctcatttttaaaaatgagatgagaataatattatggttctttttgctgggcacagtggctcatgcttgtaacccaagcactttgggaggccaaggcgggtggatcgcttgagcctaggagtttgagaccagcctggacaacataacgagaccccatctctacaaaaaaataaaattagccaggtgtggtgttgtgcacctgtggtcccacctactagggaagctaaggtggaaggatcacttgagctggggaggtcgaggctgcagtgaatagtgaatgcaccattgcactacagcctgagcaagagagtgaggccctgtctcaaaaagataataataatactacttatcgcaaagagatcatgcatacaaaaactctgaataaactgaaagacactatgcaatcatcatcctaatcaatgtgaagttatagtggtagaagaagtgttgaccactgtctcacacatatggctgctaggcagctccatggtgcagatggcagaagtcaccacttccacgatcaggacatttccagtcatcatatgtatctttgcaagcagtcttcatttcatgttctgctccagtgagaggttactattgactttttgccatgacttttttcttttgcttttttgtctttaaatttcactttcattgaaatattatgattcaaatatgtgaatttatcattcctcaaaacatatacatataaaatcccagacagtacctggtatagagtttcgacttacaaaactggcaaatatgacccaagtattttgggggattttaattgtaacatatctcagacaagactaggatgatggagggctcgaggtcattgtcttaagtgataacacctaaccctgcaaatgagttggaagataaataatacattgtctcaaatgcagcagagaggtctagaaagatgaggactgaaacaatcactgaatttggcaactgggacatcacaagtgaccattacctgaatagcttcagtaaagatttggaaggggctactgagaggccaaatctgatctcagtaagtacaaaacgaatgaaagataaggaagttgggatatcattcctgattactcttttgagaaatgtaagaaaaagactaggtgggagctaaaaagtgattgaggggtcaaggaaagtgtgaaagaagaatataagagacctgtgtggtttccaggctgagtaaaagaatctgtagaaa

SEQ ID NO: 9332 - DNA, 5466 bp, artificial
  synthetic oligonucleotide
tttttattagacaactctgacttagaacttagcacctcataagcccataaaagatgttggccactttcatttcccatcccaagaatttctagagatttgctgtcagtaaagactaatgataaaagggaatgtgggaaaagaaaagatagataagggaaaaggaaagaaatatttattaagtaccctctatgttgctaggcacattaaataccctacaaaaacctcaaggactgtgtattatcatccccacttggcagatgaggaaataaaagctcaaaacaaatttcccaaggtcagagctgagatttgaacccaggtgtgcttgactccacagcctatgctcctttcagtccctcatactgttgaaggatggactctaatggtacagttttaataacatgacagtgagattttctgtcatatgttgggctttttagaatcccttaaatcagccacacaggaggtcacctacaccaaccaagttaaaagctggtgttagacacaaatttctctctctctctctctctgtctctctggccctgggttcatggaattgaattggctgtacactatattccatggcacagggtcatcatacatccatgggcacccctcttgctttgtgttattttcctccatcatcccccatctcaagaccattccccattggctctcagttgagcatatgtaatggacatccttccaatctacccacagtgtatttatttagatatatgggtgtccttgaaaaatgagtagtattgtgtgctaaactgctttcttttctgatttattcctcatttttttcctgagagctaataactacaagtgaatacagcccactgcttctggcggctacaccatattccatcatatgtaaccaccatatttcacttattcattctctcagtggtgaacacctatatcaactctgactcctttctattactcacgatgctgggatgaccactgtcatatgtctgcttggtgaagttttgatggaataaatactaggaatgaagtttctggggcataccctatattcagtgttagcttcattggataatgtcaacttgctctccacaatgaacacagttacacccacttgccaaacatgaagtttccatttcttcccatccttgccagcacttcacagtacccaactttgtattttttcttaatttgaagggtgtcaagtggcagcatattattcaaatttctatgtttctgcatattggtgagaggaacatttcttcatattcttatcagctttccatagttgagtacaggattttcttaagatctggtgcctggagttaccaccaacacaagcatagaactttacacaaaggagaaatgtctccccccaagagagtggagacggtatggatacacggttttgttctcccaactatgttaatgctctgaactgagcaagtacatcaattttctacagatatgactgctctagggcttggagatttgcttgtgcaataaaatttcatggaaccaaaaccggtattgtgataaatgtgtcttttattaccttttgggactatttttaaagtgaaatgaatgagaattgaggttgaatggattcaagtttggcagacctaatggagccacatccagtccaggggaggcaactcaggctacgatgctcagaaagaaaaaagaaaatccttattctacccaagcaaagcagggttaaaattggataaagatgctttggcatcttatttagaatgcaattttaattctagtttattttaatgtgatttataagggcaaggggttttagatcagaactttacttttgtcttagaagtttgatgataggagaggtttatgttcaaatttgtgatattttaatatttagataaaatgaaatgtgcagtctagaagacagatatgccttggtgtgaatttaacaaaaaactctccatatacatttcacatcattctgggggtaaaattgatcctagagaacagaagttagtttttatgtgagggggtccacactgataaatttctcatctctttccttgaggaggcagtcatggctaagcgtccgactctaatatgttaatagaaaaaaaatcagggaatgttcgaaggagcctccagacccctccctaatatccccatgaggcaatactgccagctgctctctgcctttctcactaatccctgaggatgagggggaggcaggaggtgggatccagctggtaagagtaattcaagggactgagtatgctcagctcaggcccttctgagctctttttctttctctttctctcttcttctgtcaagaggtaagcctgcctctgaagaagatgcctgtgactgtaggtacacctctgcctggacgtggttaatgaagccggggaagtattaagaagcccaacaggtctcagatataagtcgtgtgcttttatctagattttactggtaagaaagatgatatttggatccctatctggccaactcctcagtctccctctcaattcgttcggaacttgggaaggaaagaaagacgtacaggcataccttgttttatcacacttcctttattgtgctttgtaaatatatgtattttttttttttttacaaattgaaggtttgtggtaaccctatgttgagcaaatctatgggtgtcatttttccaacagcatgtgctcacctcacatctcaatgtcacattttggtaattcttgccatatttcattatcacgttttcattatcactatatctattatctgtgatctttgatgttactattgaaattgttttgatgcaccacaaaactgtgccgacataagacacatcgaacttaactgataaatgtgtgttctgactgctcccctaactggccgttctccatctctctccctctccttgggtctccctgttctgagacacaatattgaaatgagaccaattaacaaccccacaatggcctcgatgtgttcaggagaaagaaagagtcatatgtctctcactttaaacaaaaagctagaaatgattaagcttagtgaggaaggcatgtcaaaagccgagacaggccaagagctaggcctcttgcaccagttagccaagttgggaatgcaagggaaaagtttctgaaggaaattaaaagtgctactccagcgaacacacagatgataagaaagcaaaacagcctaattgctgatatggagaaagtttgagtggtctggatggaagatcaaactacccacaacattcccttaagccaaagtccaatccagagcaagaccttaactctcttcacttctgtgaaggctgagagaggtgaggaaactgcagaagaaaagttggaagctagcagaggttggttattgaggtttaaggaaagaagacatctccataacataaaagtagaaggtaaagtagcaagtgctgatggagaagctgcagtaagttatccagaagatccagctaagatcactgatgaaggtggctacactaaacaacagattttcaatgtagatgaaacagccttatattgaaaaaagattccatctatgactttcatagctagagagaagtcgatgcttgtcttcaaagctttaaagaacaggctgactctctctcgttaggggttaatgcagctggtgactttaagttgaagccagtgttcatttaccattgtaaaaatcctagggcccttaagaattatgctaaatctacactacttgtgttctagaaatggaagaacaaaacctgaatgaaagctattctgtgtacagcatggtttgctgaatatttaagtctattattgagccctactattcagaaaaaaaaatattcctttaaaaatattactgctcattgacaatgcatttggtcaaccaagagctctgatggagatgtgcaagattaatgggcctgctaacacaacatccacttagcagcccatgaatcaaggagtaatttcaactttcaagtcttattatttcagacttgaaagtcaaaattactctttattataattcatattaacaattaatattcaataatttaattgatattaatcatcatcaattaattattttattaattacaagcataataattataattataaatttcataaggctatagctgccatagatggtgattcctctaatggatctgggcaaagtaagctgaaaaccttctggaaaggattcactgctctagatgccattgagaacatttgtgattcctgggaggggatcaaaatatcaacattaataggagtttggtagaagttgattccaacactaatgggtgactttaaaggggttcaagacttcagcggaggaagtcactgcaaatatggtgggaatagcaagagaactagaattagaagtggagcctgaagatgtgactgaattgctacaagctcatgacaaaacttcattagatgaggagatgattcttatcaaagagcaaagaaagtagtttcttgagagggagtctcctggtgaagatgctgtaaacattgtggaaatgacaataaaagttttaaaatatcacataaactcagttgataaagcagtggcagggttggagagtactgactccaattttgaaagaagttccactgtgggtaaaatataatcgaacagcattacacgctacagagaaatatttcgtgaaaggaagagtcaatcagtgcagcaaacaacatcgttgtctgattttaagaaactgccacagccaccccaaccttcagcaaccaccactctaatcagtcagcacccatcaacactgagacaagattctccatcagcagaaacattaggacgcgctggaggttcagatgatcattagcatttttcaacaaaagtatttttaaattaaggcatgtacttttttagatataatgctattgcatacttaacagactacaaaatagtgtaaacataacttttatatgcactaggaagcaaaaaaatgtgtgattcgctttattgcaatattccctttattacagtgatctggaactgaacccacaatatctctggggtatgcctgtgttctttttggtcttctcaacctcaactccctacatttgacttccactgaattttaggccctcttcaataaacgggtctgcttttgtttggctgacagactttgtcagttaaaacctacaaaaacacttaatgacagtcaccagaactcttgctcaaaacttcttttggactgacatgtaacagatggcctcaaatccatatctgatgctgggaaaatccaccagccaagtcttggtagttacctagagacactcaaagtctcccaaggcagacaaaaacaggtgggtactgactcctgacaagcagagctgccacagccaggagtggaggctgctgaggaaaagaatctggctgggggactcaattggcagaaaacctaatgaaacagaggcagggagcagtttacaagaaatctgtttg

SEQ ID NO: 9333 - DNA, 1881 bp, artificial
  synthetic oligonucleotide
ttgtaatatacgtaatctcaaatattctttctaacaatcacttgcagttggcagtattattttaattttgcagacaaagaaactgaagctcagagggctttacaaacgtgtccaaagtcacaacagctaacaagcagtaaagccaagattcaaaccttcagaatttcttttctgctgtaatctaaaggggactttctactattgtgtggatataagtgacacatgctgcctttaaatgctgattttttaatatcaattttttcatagaaatctttctaaggttttgatggctcaggctatgcttatacacagcaacaattacagaattgcacataacagaacgatgccactggagccaggagtgctgcttgccagtgaattgatggtttcagctgactcttttctatgttggctgcacctgttcttctgactcccttcatcacttctttctggtgttctgttttagcttccaactccttatctgcaatgtgctctctgtgtattataggaagaactgaggttgccaagttaaaccagataatgttacaaaccattctgatattagtaggttctggcctatgtgtagctttcatgcctctttcctgtattggattgaaagatataaaatagacatttttgtcggtcaaaagtcgcagtttcatatggctcagtctaatattaaagggcactgaccctgacatatgcatttttctagtgctcatcaggtttttcttccgtttacctcacagttcatggtggtgctgcagatgattaaagcagcagtagattgctgccagaaaagtgggctaagatctaataactcctcaaatccactgtgttctataacaacaggcagggtcagaaggccagaagtcagtccgactgcctcggcactagtcatccacacactaaaatagttttcaaagtttgtttttttcaggagcttttgcacaattttctcctcaatcctctttataagaatgacataaagcagtcagattgactaaacagactcacaacatggtgactgaattactcaagggaatgaaatagacatgagaaagaaacctggaaatttgggaataaaaacctcccaagactcctaaaatatcagaaactttacttaaagagcagggattcatcacaaaaagactatgaaatgcatcctatcttcctctcagttcaaagtggggattcttttttttttttttttgagacggagtctcactgtgttgcccagctggagtgcagtggcgcaatctcggctcactgcaagctccacctcccgggttcacgccattcttctgcctcagcctcccgagtagctgggaccacaggcgcctgccaccatgtccggctaattttttgtatttttagtggacacggggtttcaccgtgttagccaggatggtctcgatttcctgacatcgtgatccgcccgcctcggcctcccaaagtgctgcgattacaggcgtgagccaccacgcccggccaaggtggggattcttttcaaagggctctatgtgagtatgcatgtagatttatatttctacttctatagggctgatctattttcacttatgctaaaaacaaaataaatcaattgtataaagaaagaaaattaagagacaacaaagatgtgttgcttccagattcaaatttccaggggtaaacaatagggactttatatgatttctgaagataaagaatcaataaagataaaactttaaaataaacccatagaaatagcagaaattaatgaaaagacatgataaacttctggtataatttcttctccaaggaagagagaaaaactttcagttatccacaacatttaggcattttcttggaaaccagtagaaagtacatgttaagaaagtt

SEQ ID NO: 9334 - DNA, 1484 bp, artificial
  synthetic oligonucleotide
gatggttgtggctgcctttaaacacacataagtaaaagaaaaacttaaatgtctgagtttttaaaagttaaaaaataaaaacaaaatgctttgcttctcagtaactgaactttcaagggacatatttattttgtctgattactccgagtttgtatgtgcaggcatacctagtgtccctgtgttccaagccactgggagaggatccacatgaccccagtgtagggtggctttgagcagtcccactcctttgatctgtcacctaattcagttagactcttgcttttcattattggtacagaggagattgcctaaaataagacttccatctcacacatgtttttcccacctaaatgttagttactaggaataaagattatgaccctactcagtttgtctgaaggctttttccagaaaaacaaactataatattgcagtgcttttcagttgagagaaaaggaaacaagaaccacaaacctttggaatggaaatcggatgcgtacaaaatggttgtcaaatgctacaggcaaggcagggtacaatttaatgttccccctgaagtagttagtagaacaaaaaagaatatttttaaagcaatccgtgttctttaaattcatgagcagctggggtttatctgcaatcattgtgtgtacctgggaattcatgcaaggcagggaaatgcaatgggattttaatgcacgttgaatttaataattggtgaagtggacatatgttttgtaagcatttatctaaataataaaatgggttttaattgcttttagatgttcctcatttaatcaaacaacaatgatatgaagaagtcaaaacccaaagagttgaagtaatcgttatgggtacttaagccaggattttctgcctctaagtatagtactatttcggctatatcagttacctctactcatttttttaaataaacaaaaaataacaactattttcttaaaaatactattcctaagagtttcatattttttactaaaaatgcaatagactacaggacagtattgaaatcacctttatttttgataaagataaaaaggatgttaaagttcccagtagactgtagactcttttttcaagttaaaattccctatgacataatacaaaaatactatttttgttcttcccacagttccaaactcaatatcctatacataataggtatctaagaaatgtttctttaaaaaaaaagagatgaataaacatcacatatatatttccctctgatgacagaaaaattaaacaatcctcagatttatagatggagagacaggacaaaaaaaaccagctattcttcccaacaatagtatacatgtatactgttttcaaagaaaaggaaaatcaaccaagaaaatcattgtcattttggtcttaccatgttggataactggttctcttaatggctccccagcaattaagacaaagtggcttctcttgggatcctaaagttaacaaagaaaacatcaaac

SEQ ID NO: 9335 - DNA, 1785 bp, artificial
  synthetic oligonucleotide
aaaaatttacattactaaagtttcaggcataaaattatccttcccactggccaagttgaactccctgactgttagtaagacatgcaaatacttaagacatctttattttataaaaacatcatttccactcatatgcctggcacatggtagacattccacaaatatttactgagatgaatatgtgtctttccttttcccagggagaagatgcctcctgagaaataaacctgtcttccttcagcacacgttaccccattgaccagccatggttgtttcccatcttcactaaagttgttctgaatgtggtaatgtgatttcctaagcaaagtatacgttcttccgtgcattaaaggaggcatgacacatgacagaaatcagtgaattttttttattccatctccttctactcctcccaagttgtctcaatacaattcattttccagcactgctgtaaaattgagaatgtttttgacattctacagtcaaaggtgtgttcagaagcacttagaagtcaccaatgtgaagaactcaccatgtgtcacagtcattaatacggtttgtcaaatatttccatctctctgccttctgagcgcatggtgggattgcacttcctggccctttgtggctagatggggcagtgggtcaaggggctgcaactagaagtaatatgtgtcacttctgggccagagaatttaagtgccagggtgaggcgctctcaggctctccctccctctgtcatagtgattcctaacattcaagatcggatactcagccagcttcatccccatgtggatttgaccccagatgaaccaggctggtcatgtggtataagcaataaataagtctctgttgtttatgaaccaccaagatttcgggggtgtttgttttcacagcatatcctggcctaacctgataaagtatctgaccagagtattttgccataatttaccatgattttacaaacaacctaacataaaatgaaagcataggtagcatttctaaggctctcagggatgaaggaaaacatcaagatgttgaagttttgtccagacccctgtgcagccaaatgctactttgctcatctctctttctgttaccaacaggctggaataatgggctcagatgacttccttctatacctctggctcctaaaagggaacgccttataggatggcttgtgcctggaaggacagtggagaagtctttgatacatccacacaaaccctatcctatgcccacaggaaaatagcacagggtgaatatactgccttaaaaatgctttagaattttttttaaatcatgaagtcagacaagccatcatgagagtagatgttggagatgatttaatgcagtagttcatatcctgatcctgggtatctaaaaatcctgaggtctagtccatcaatcagtcaacaaatactgtttttagtatctactctattacatacaggcttttcactggtgattgggatgctgcagtaaacaagacaattaagagctccttttctcaaaaaacttgtattctagtagacggtgacaaagcaataaatgtatacacaggcaaataaaacatgtcaggtatggatgtgtaccatgatgaagataaaacagtgtaataatttatatataacacaattgccaaactatgacccatgggccaaatctaacctgcagcctgtttttgtatggcctgttagctaagaacaattttttacattttccaatggttgaaacaattttttttttaatttcatgatgcaggaaaattacataaaattcaatttt

SEQ ID NO: 9336 - DNA, 727 bp, artificial
  synthetic oligonucleotide
tgctgatttccatttacctctactttttaagaagtaacacaactcataaaggagaaatcaaaaaacaaataaatgaaaaatacatacacatgcacacacagacagagagagagagacagagagagagagagaaagaaaaagagagagagagagcagtgcacccagtggtttaaattcaaagtagcaagaaagccagatgattgcctagttgtggaagaaagacatgatggcttacctcctctgtataaatgtagaccctaaaacatacaaagcaaatggagcctgcacactttcattcattcatttcacaaatacttaccaggcccctactcatttttcaaggtgctggggatgtagtcataaatataaataaagtagccttcataactaagacttcaataaatgttccctggggagtcagatttacccattgtcaacctattttaatgcttgttcttaaaatagtgtatcattgggataggcagcctctaagatagcacccagtaatcctggaatccaggtattgcctcccttgtataatccctgccccttgagtgtgggctggacttgttgactcacacctaatgagtagaatatggcagaagtgacagaatgtcacttcggagatgaggttataaaacaactgtgacttccttcttaggtacctcttgcactctctctgagagaagccagctgccatctcatgacacagccctgtggagaggct

SEQ ID NO: 9337 - DNA, 357 bp, artificial
  synthetic oligonucleotide
ccctccactgggatgggtgtgcaaactatacagcttgaaacggctttaaagcacttgggctgctccagggcacagaaactatactggctcttcaaaggacatcttctcaagccacctctatggtgtcaagacaagtcgaactccttcccttcccacttgaaacccacagtcagatgtgacaggggctggtactcaagagcgttaattcttgtcattttttttgtcatcatcctccgagggttaggaatgccatgtcagcctttcctcatagaaggatatgacaacctgtgggcacttgacactggcttccttggcagggaccaggtcagcctcatgagtttttccatttcatcagga

SEQ ID NO: 9338 - DNA, 7819 bp, artificial
  synthetic oligonucleotide
atgaaccaacctgccagaacctggaaagtatctgggtgctgtattcacaattattgtggaccttggtttgatcccaggacaaacagaaagaggagaaaaagaaacaagaggcttacagtcagaaacaaacagaaaggcccactgaggcaactcttgggcaagtcaggcctgtccactgcagttctttctccagttccatcatccagcctctcctctcctctttcttctctctcttctctctcttctctttcctgtctccctctctcttctctctctctctctctctctcaatataaagctgccttctccaaagggccctcacattatcacccattctgtctcaacaggcaggttttcccccagaaaactcacccctcctgaggtgccccaatatctaaaaattcaccataagacaataaaattgttttctttcaatacctgttctagcttgtcttctgtttaaatgtgaatactctctacagggtgggctcaattttgcaaggatagaaatatctctacagttgtcagtcttcaggcaaaaccccaaaagatagacactaacactgggaacagtgattacctgcttggtggaattatgggtggttagtttatccttcaatgtattttcctaagtttctatgagtaggtataaattagcctcctagggataccataacgaaacaccacaaactgggtggcttaaaacaacagaaatttgttgtcgccgagtcctagaggctagcagttggctagaagtctgaaatcaaggtgtggacagggccatactctatccaaaggctctagggaaaaatccttccttgcctcttctagcttctggcagtggccatcagtccttggtgttccttggtttctagatgtgtcactcctatctctgcctctgttgtcacatagcattctccatgtgtctccttctccttttcttatagggactctggtcatgttggattaaggtccatcctaccctacttacgacctcacctgaactaatcttaactaataaggtcacattctgaggcacgggggttaagaacttaaccatatatattttcagggtacacaatttaactcgtaacaagctactttcaggaaaaaattaagacattctttccctgctccttggacaggagagtctaacatgaaacaaatctctataaagagttggttgcccatttttatagcctttcctccctccctacccccagggaagtgggcagaaaaacgcctgcaggtggaggtgggagcagcaagatgatccacacctgggccctattttcccctctaacttggccttgtgcaaagggacaagcttcacctgagctgagtttcttggcacagctatttgaaaacagcattctgagtgttccccattccacacttcaccaaggttaagacctcagaagcataaacaaaagcaaccaactacaattgaggttttacccaaggggcaggactgatgcaaagcagacggagaatgactccacttgagtagggagaggtggaaagtctaggagggcttcatgggggcaatggctcagctgggtgtagaaggtgagtagcaatttgccagtcagattcacaacaggaggtaagaaaccagaagtatccaggcacctacccttgtgacttctacttctttgaaaacttctcttcccttagcacctgtgtaattacaacatccagaatctctttctgcttctctgtccaacttactggtcctacttcatcaactggaggcctgtcccagggttccatccttggttgactctcagctcttagccattggacaatttctcccttccctaggtttcaaccacagcccctctgtaggacattctgaggtatctggcttctaacctgtgatcgttcctaagtctcagtcccatgtcatcatactgtgcactgggcatcattgttagcactatcatgtccaaaacagaactctgtatcctcccctcctcatcctgcatccaaggcaacttcctttccaacttccctcttatctagcttatctgacattactttgggcttgagaaccttataattttgcctgccttctgttagttccaacatttaatcaagcaacatacgctgatttatctttcctttgaaatcatcgccctttctctgtcatttccaaagttcgatccaaatgtaagtttcatggttggattagtgcagtagttttcaaagtatggtccctgaccagtaccatccatttcacctgggagtttgttatgaatgcagattcctaggcccccaccccaggcctacgacttcatcaaaagctgcatcatctgcattttttttttttgagacagagtctcgctctgttgcccaggctggagtacagtggcatgatctcagctcactgcaacctccgccctcccaagttcaagcaattctcctgcctcggcctcctaagtagctgggactacaggcatgtgccaacacacccagctaatttttttttttttttttgagacagagtttcactcttgttgcccaggttggagtgcagtggtgtgatctcggctcaccacaacctctgcctcccgggttcaagcgactttcctgcctcagcctcccgggtagctgggattacaggcatgcaccaccatgcccggctaattttgtatttttagtaaagactgggtttctccatgttggtcaggctggtctggaactcccaacctcaggtgatccgcctgcctcggcctcccaaagtgctgggattacaggtgtgaggcactgcacccagtcaaatgtttgtatttttagtagagatggggtttcaccatgttggataggctggtctggaactcctgacctcaagtgatccgcccacctcagcctcccaaagtgctgggattacaggcgtgagccaccgtgcccagccagaagctgcattatctgtatttcaataagctctccaggtgatgtagaggcacatgagaatttgagaaccactggatgaatgcaaccatctcccacgattccaacacaatctatcccagctgtggctaccatgttaattgacctacagccttattaccaggtctctgttctagaaccaccaatggctctcaatttcctgcctcatgaagcctgacctcctccacttagctcttcaagctttatctgccactccatctcttcaaacttgttctcactagactccctaagacattcacattttgcactctagctgtaaaaacttgttgactttacaagcaccatgcctttgcgtataacacctgcccactcccactcacccaccctgaccccaccagggttgtattaggaactttagaaatcctgaacagttggctcacgcctgtaatcccagcactttgggaggccaaggtgggtggatcacgaggtcaggagattgagaccatcctggctaacatggtgaaaccccgtctctactaaaaatacaaaaaattagccgggcgtggtggcgggcgcctgtagtcccagctactcaggaggctgaggcaggagaatggcgtgaacccgggaggcggagcttgcagtgagccaagattgtgccactgcactccagcctgggcgacagagcgagactccatctcaaaaaaaaaaaaaaaaaagaaaaagaaaccctaacagtgaaaagtggctggtgcctctctcccatgtggaaacaaaaataaatacaatacttagctataaaataaccgtgcagaagtcaaccaaattaccgattctttcccataatgattggtttgctgttttaaaaatatatttatcggccgggcacagtggctcacacctgtaatcctagcactttgggaggccgaggcgggcagacttccctgagctcaggagttggagaccagcctggggcaacatggtgaaaccccgtctctactaaaatacaaaaaaaaaacaccccaaaaaattagccaggcgtgtgcctgtagtcccacctagtccctgcctctccctcctgaggcagaattgcttgaacccaggaggccgaggttgcagtgagccgagatggtgccactgcactccagcctggtaacagagcgagactccatctaaaaaaaaaatatatatatatatataattatatatataattccttgtaaaaagtggccgggcgtggtggctcacgcctgtaatcccagcactttgggaggccaaggcgggcggatcacgaggtcaggagattgagaccatcctggctaacatggtgaaaccccgtctctactaaaaatacaaaaatcagctgggtgtggtggcggacgcctgtaatcccagctactcaggaggctgaggcaggaaagtcgcttgaacacgggaaggtggagtttgcagtgagctgagattgctccactgcattccagcctgggtgacagagtgaaactccacttcaaaaaaaacaaaaaaaaaaaaaaaaaaagaaattctttgtgaaaagtgatttttgatgccactcttgctttcctagttctccaaactcatgctcaatacatctgctgattaatccagttctgcctttgtggatctaaatcccactcaccattgagtactctgctcattttataagtgaaattggataaatgaatgaatgaatgagcaggctagtctactcagtcaaagggaagacgttttgtgttttatttcttccatttttacctttttggtacctgtatagtagattaataaaccctgactgacggccgggcgtggtggctcacacctgtaatcccagcactttgggaggcccaggcgggcagatcacctgaggtcaggagttctagaccagcctggccaacgtggtgaaaccccgtctctactaaaaatacaaaaattagccgggtgtggtggcgggcgcttataatcccagctactcgggaggctgaggcaggagaatctcttgaacccgggaggcagaggttgcagtgagcggagatctcgccattgcactccagcccaggcgacagaatgagactccgtctcaaaaaaacaaaacaaaacaaaacaccctgacttcagggtccctgtttattgcccctttgatcaacaggtgctgtggacagtataccaggtatatatttttttcttttttctttgatacggagtctcactctgtcgccaggctggagtgctgtggcgagatctaggtgcactgcaacctccgcctcccgggttcaagtgattctcctgcctcagcctcccgagtagctgggattacaggcacgtgccatcacacccagctaatttttgtattttaggtagcgacggaatttcatcatgttggccaggatggtatcctgacatcgtgatctgcccgcctcggcctccgaaagtactgggattacaggcgtaaaccaccgtgccccgcctatatatacaggcctgaacccgggaggcggaggttgcagtgagtcgagatcgcgccactgcactccagcctgggccacagagcaagactccgtctcaaaaagaaaaaaaaattaataaataataaatacagcaattcagcagggctgctgcaacaccagctttcccagctctgggtgctggggcttgtctccgtcacaagcccccaaggatctcaacagggtgaacaacagttgcagaaagtgagctgttgccttcaccctcaccctgctgctccctttgctctccgaaagttacgaactttgagtttccttcccgataaactccaaggtttcctcactgattggtctcagtttgggaaaggacgtgacatcagcaagtttgcagacttggggctggagagttaaccagtatattactaaccaatatactattatttataagaacctgtgtgcaaatgcctaaacccatttttcagaatcctttcagccaacaggcacctgctgaatgctcaccgaagtgtgtatttgtgggattctgtacattagcacagacaccacttgacagatgagaacaatacctgtaagatgattctccaatgttttaagtaaaacaaagtctcttttgtctcttttgaaagtgactcaatcagtgctcaatgtttgaacatctttataaaccctgccccacctaaatgccaaacacctaagacttacaaattaaaaagttttagcattaaaaattttcctatttataagtaactttcaaacctccaatttaataaataatgcatttgacccacaaagaatgattcctgggagctgaaattttcactggagaataatttgtgacaattgaatttgtcttgtctgtaggattctgcagaaagaagtatacacatttttgaacagctgtgtaaagaatatataccagtgagctgtggacatctgcccagtaacagccccatggacacctcacacagagccactgaaactgcccaaccctcctctcctaagcacattagccaacctccccagggctgattccactgcccctatgactcaccgcccatcaatgggtttgaaagaagcctgatgccaggaaagtcccttggccccgcgggcttgctcccatccatgcccccttgtttgccatccatgatgctctctcctaagcgagcaagctctgcgctccacttcagttgctcagcaaagtccaaactccatgctccccctgctcctgaaaaattccagttctgtggctggctgagctgcacacgttctggtcaaatggtctgcagcaaagcacagagcaggcagggtaatctgagtgctacctgtgatcagagagaggcatgcgctcgtgtacacacacacacacacacacacacacacacgttttacctaactggctggaggcccgccagaggccacaagaaccctccagccctaagtctgcgaagttgctgatgtcacgtcctttcccaaactgagaccaatcagtgaggaagccttggagtttatcaggaaggaaactcagtttgtaacttttgagagtgaagggagcagggtgggggtgaaggaaacagctcactttctgcaactgttgttcaccctgctgagatccgtttgttacatggtagcttgttatggagacaagcccgagcacccagagctgagaaagctggttttgcagcagccctgctgaattgcttgcacagtaacatgcacagcacgccctggccatctgtacatgtgctttcaattgtgctgggagtttcttatgggaaatgtgtctatatgttacaaaaaatgtacctttggaaagaaccatttgttcctttcagctgcaagaatttcactaaatgtcctacctcacccctcctccactcattttaacttctaaataaataatgaacggttgcaattggaaaaatggattgctaggtggcctgagatgtggaagagacctgctatcttttcattgtgaattactaaaatttattttgttaacgttttgctgtttttgcttatacaaaacattaggggccgggcgcggtggctcatgcctgtaatcccggcactttgggaggccaaggcgggcggatcacgaggtcaggagtttgagaccagcctgactaacatagtgaaaccccgtctctactaaaaatacaaaaaaattagctgggcctggtggcaggcgcctgtaatcccagctactcgggatgctgaggcaggagaatcgcttgaacccaggaggcagaggttgcagtgagccgagatcatgccactgcactctagcccaggcgacagtgcgagactccacctcaaaaaaaaaaaaatttggatgtactgtgtccatgtcttttcagataaacccagttgcctcacacccctgggtgctacttcaggctgacaggcacctc

SEQ ID NO: 9339 - DNA, 1128 bp, artificial
  synthetic oligonucleotide
ttctaaagcatgttttaaataaatgtaatactaaaattttaaaacagtatcttaatttttaaaaaactggcctaccccataatgaatattagatcatcccaaaaacctgtatccaatatgctaaatagcaggacagttatttactgtactgtgaccagtactgtatctcattgaatattgaattatctcaacttcccagatttggtgatgtcagagaatgatctttttataggaatgggagccagaaattgccaaatacctgccttctactagagccccaagggatgtcaacagattagggcttaggttttggcaaagaagcaccttctctctccaagaagagctgggccaaggggctctctggaggcaccagctccacaggacgtttgccttcagcattcttggcctgggtgtccgctccaaaatccatgagcaggcaggccagctcttcactggctgtcctggccactgcatgaagtggggaatcctgacctttcccttggttcacgtccgctcctaaacagtcacgagaacaaaaaagagtcagcaaggagcagaatccaaccatcggggcttttcaaagccccgagccccaaaatttcctaacaagaggggatccatattgagcacagcaatcctggaaaaatgggagatgatgtgattccatttaataatgtggggaaaatcccacctgataatgttattgaatgtacagcatgaggaatatagcatagaaagttaaaaatttgcctttcagcactgtacatagataggcatgatgcatataagaaaaatcctagtgacataaaagctccacattattattaatggaacctaagtattagccagtacagcctgacggagagactagatggtgaaatccagcctacaccaagcagccaaactcacctggtgtgcagctgccacagggtgtaaaactggacacttgggactggtgatttggactttgaaaagcaaccaaccaactcatgggggtatcccctggattggactggccaatcccaagatcacagggaaggtggcaaagttctccctttcaggagtaaggtggatttctaggactgtccccacccaattccactcttacactcttaacaaatccccacc

SEQ ID NO: 9340 - DNA, 985 bp, artificial
  synthetic oligonucleotide
acactctggtgccccaacatcctttaatggttccattaagtctacccatacttctaaataattccttcagtaaaaatatctcttcaaaactccgggctcagtgtactgttttctgcttgacttctgacctatatgctcattttccttggcccaatttcccatttcacttgtgtggttacaagaccagagaagctaagagggcatttctaggctattgtcttcttctgcctactatttacaaccatccaggatgctaggcaaatgtcttccaccagtcttttttctgtctccatatttctgatatttttttaaaaaccgagaaagacagaataaaaattgttcacaacgggacaaggattttcttttcggcttaatagaaattagagcttagagtttaaagctaatttaaatttctttaaatgaggaagtttaccttgactatttatatttgcaagcttaattgttcagctttggagcattttcaataatttttgaatgataataaattatttgagtggcctcttttatttataaagtgcttcatttggctgtatttcaaaaaatgcaacttggcaaatgatacttgttatataaatggttcagaaaagaaagaaataaagagctgataaggtatccattttcgaatcactgtaaatgggtcttagcacttgaacaacgttcatcaaatgagtatttaccattgtgcctaattgcaaagaggctactttctacaattgggttgtaacataccctatgcctattaatgcaactgaaattttatacagataaatgaggtattatgtggaaaattctttggatcttaggtgaaaaggagataccagtaaggtgaaaacactggacctggatctatccttagctatgacacattctagaaataaaattttcaacaagctactttgccaattcatgcttcaggttttagtaataaaaaattcttgcttcataaataataagttagtttgtg

SEQ ID NO: 9341 - DNA, 2113 bp, artificial
  synthetic oligonucleotide
gtatgtcttactcatagttttgttgataaaaaaaaaattcactttggaaattatttgggaaaggtttattaatcaaaaatccttgagttaaaatatgatttctttattatgccaaaggtttcagtgcaggttaacatgttccaatccctataataatctgataacctgatagacagggaaggattaatgctgattctaatggcacaaaactggcagtctcatgaaaaggactaaataagatgtttaaaaagcacattgcttttgtcctttttctttctttcactagttttttccttcttaatcacattacaaaaacatttcagccctcacatttcagagtaagttgcaagacttggagtatggtacaaaaacactccaacgacagaagatatttccagttgattatgctacttgaaaaagtgaagaggctgagaatatgaaatattaaactgcctctcctgaaactcttctggaattctgtggccaccactgcacaaaatgttcccttatggtatagcaaattggagccttagggatgccagttgttgttccgttcatttaagcatttaggccacaggcattttaagagggctcctaagggattttcgttagttccttcccaccgtcatttctttggcatggttgatatggtttgcctctgtgtctccacccaaatcttatctgaaattgtaatccccacatgtcaagggaggcacctggtgagaggtgattggatcatggctgtggatttccctcatgctgctctggtgatagtgagttctcatgacatctgatggtttaaaagtgtgtggctttctctctctctctttctctttctctcttgttttgccatggtaagacatacttgcttccccttcgccttccaccatgattgtaagtttcctgaggcttccccagcgatgcagaactgtgagtcaattaaacctcttttctttataaattaccgagtcttaggtagttctttatagcagtgtgaaaatgaactaatacaatggtgttggcagatatacatgttaaagtatttaagcagtctccaatctggcaaaggaatctatgggcattgggaggccctaaagaatgaaccgatccaagagattgttgagacttaggagtgggatactgataacagaaaatcatttatcttgcatgaaacagaactgctgagacacaaaagagatttagaaatcaaaatggtacctgaagaaatatgatttcctttttgtgattgaaagacatcttatcatacaccccaaattatcaggaatgttatcaacactgatgaattgcctagacacccccagctgttgggagtgctatcggctgtcagccctcactggggactatctcagctaaatctagctgactaaatcaagcccatgcatttttttccagggcaatctcattcaatgataattgacccaggatgcataaagactcagaccctgggcttatccctggacaattttgaaggaacatccagctccaaagttcctgtggattgctaatgggactacattccagctcaacttctccctagcccaatcctgcttccttctataggtgttggaaggtatccaaacactccctaataaatacctcagacttcaacttcaagttccattctatatcatctccaagtttgcttctcaggcaacccaacttataacaaaggtgaagagcttaaagtgaaagtgctttgccaaaaggcataattatacctccaagtctatgggagcagcctctttatgtttgcacagtgtttcaaagtttatatctcattggagtttttggtccattctgtgagttgaggacaattttatctccaatttaaagatcagaaatttgagtttcagaaaagttccatgacccgtagtacacggctcaatttactaaatcattggtagaatcctaataatgatggtgtagagtggccttaagtttgggtactgctaaacttgactgttacttcctgtatgagttccactgccaccaaaacaaattaccacaaatctagtggcttacaagaacacaaatttattatcttacagttctgtaggtcagaagtccttgaaggcttagctggtttctcagc

SEQ ID NO: 9342 - DNA, 912 bp, artificial
  synthetic oligonucleotide
taggcagttgaaattttttccagtgggagaaaattaactatggtaactatttttatctactaacattataatttcatgttggctaaagctgcctatagctttattggtaatagtcagctattaagggaatcgttgagaatactcttttagaagccccaatctctgttcttcctttgccctctaagtagtcattaaaagaaaattacacaggcatagtaaaccagttaaaattttcagagctttttgagccattgctttagctgctggtgggtgatttgttttaatgtatgtcaccttttctttttaattttacacaacactttctagactgtacacacccaaaaaaatccataacattgtgatcattatactatattgtgtactctaccctttaaagaaaaaatagaccaaggatcgcctagctagctgctgtttttgttttttgttttttccccccactcaaagcctctgggttgggctttggggtgataagtgtgggggcctaacttgataattgaagctatctgggctggagacaatgagaaggaatgtgtggaggctactactggctatcctaccctccccacacaggtctgtggagtgtgtgtgtgtgtgtgtgtgtgtgtgtgtgtgtgcatgcgcatattgtgcatgtttatgtgttggtgagaatggggtggggggacaatgataaaggtctaccagaaaaggctttgagatcaattggcagattgtgatgattatactagaaactctggtctaccaaaaaatatctaaatcgggggccagcaaacgttgtctgagaagagctatttattagtttcctagggccgttattaacaaacgaccacaaacgtggtggtttaaaacaacagaaatttattttcccacagttctggagaccattaagtc

SEQ ID NO: 9343 - DNA, 428 bp, artificial
  synthetic oligonucleotide
aaaagaaaaaccctttttgcctaagccttgagacacttgcagaccttatggccagagcagagcatcctccctattacaatagtccctttttctgccttgcaataacccttttgaagaaagcctatccttactaagtctgaatttgttttttatttgacactatcaaattgtaacctcagactgctggcctctcaactgtcgtttgcatcagctttgtctactagcagttctacttcagggctctacttggccaccaaggtgctgctgatgaggaaaatatttgtctttttcctctggatttgcatattctattcactttcccagttctccttctagacagctctaatctctgagcaggcaatactttctcagtattgtccatcagatcatacccttccagctaaattcacttgctcaatctataaggc

SEQ ID NO: 9344 - DNA, 5333 bp, artificial
  synthetic oligonucleotide
ccctaagagtagcccacaaccaatcactggtaggaattggtataaataccccaactccctaacccttggatattaagatcctgaagcatgttttctctgagagctccccaacagaattaagttctaattgtccacagtgaatggttaaatagattacaatcatatgatgaaatattaagcaaccattatgcagttaactcatgctataccaaattctttttaattattttaataaggtagtgttgagtgagagaaacaagatccagaaaggtgggtttaatacgatttcaatttgtgggtttaatatgatctaaattttataaacaatgaccaaaacttatatgtatgtgcacatatcaaagtttcttaaactctatactgttgctattttgggctggataattctttgttgtagggaactgtcctgtgcattgtaggatgttgaacagcatccctggcctctacccactacatgctggtagcaccccctcagttgtgaaaaccaaaaatatctacagacattgccagatgtgccttagtgggcaaaatttattgtaatttatggatcacatatctgtgtatatataatatgcatatgtatgttatgattacatgagcataaagaaaaaaatacaacaattatatatattacattgttaacattagttatctatggggacaaaagtgtaaaatgaacagagaaggtcagaaggagggaggaaaaagtaaggaaagcaaaaaagcataaaatgagatttttatgcatttatataagtacttttataaaaattaaaagtacaaagttttgttacttgaaagggaaggcattaccagaagccttactcatgggaaagcattggatgtcattgctttttatgcctggcacaactctttcttttgggacctgtcactcccacagcacacttgattctgatggaactgacaaccctagaatatcatctgggctgcaagagtgggcatttgacccaggccttgtgctttggtctgaatgtttgtgtcctcccccaaattcatatgttgaatcctaatcaccaaggtgatggtattaggaggtagggcctttgggaggtaatcaggtcatgagggtaggcccctcatgaaagggattttaaaatgggcttccttataaaagagaccccagagaactgccttgctccttccaccatatgaggacacagtgagaatttgctgtctatgaagaaccagccctcaccagacactgaatctgctggtaccttgatcttggactttcgagcctccagaactgtgagaaagaaatttctgtagcctgtaagctacctaatctaaggtattttgttatagcagcttgaacagactcagacaacttgccaatcatgatatcttatatttctcccaatagtgattgggctaaggcccaaacagatacttacacaagagtttgaatcacaagctatgtggttgaacatggttaacagtcaagacatagggaaaaagacaggaggacagagagaagggagagaggaagagggagacctggtggcatcatttgagaccctggatgtagatgagccttaagttaattttaccttaagacttcatgattattatgcaaaccaaaccactaaagttattcttttgttttctttgccttggattatttgagtcctgcttctttcactgtattagcccaaagattctgactaatacaatgtaataatgaattcaccaacaataggcatattaaggttttctttttgagacagtctcactctgtcccctaggctggagtgcagtggcactacgatggctcactgcagcattgacctccagggctcaatcaatcctcccacctcagccttcaagtagctgggactacaggcacatgccaccatgcccagctaatttttgcatttttttggtagagatggggtttcaccattgttgcccaggctggtctcaaactcctgggatcaagtgatccacgcactttggcctcccaaagtgctgggattacaggtgtgagccacagtgcctggccaagatttttttttttttaacagagattatatagaacatactgtggtatgggaacaaatgggatatttttattttatgggtgattgtatgatagctttgggaaatttatgaggtaattttttcttttccattcataatttttatttttaaaaaaactctcagcaactgcccaaggtaatttacagattcaatgtcatccccatcaagctacaaatgactttcctcatagaattggaaaaaactactttaaagttcatatggaaccaaaaaagagcccgcatcaccaagtcaatcctaagccaaaagaacaaagctggaggcatcaggctacctgacttcaaactatactacaaggctacagtaaccaaaacagcatggtactggtaccaaaacagagatatagatcaatggaacagaacagagccctcagaaataatgctgcatatctacaactatctgatctttgacaaacctgagaaaaacaagcaatggggaaaggattccctatttaataaatggtgctgggaaaactggctagccatatgtagaaaactgaaaatggatcccttccttacaccttatacaaaaatcaattcaagatggattaaagacttaaacgttagacctaaaaccgtaaaaaccctagaagaaaacctaggcattaccattcaggacataggcatgggcaaggacttcatgtctaaaacaccaaaagcaatggcaacaaaagacaaaattgacaaatgggatctaattaaactaaagaacttctgcacagcaaaagaaactaccatcagagtgaacaggcaacctacaaaattggagaaaattttcgcaacctactcatctgacaaagggctaatatccagaatctacaatgaactcaaacaaatttacaagaaaaaaacaaacaaccccatcaaaaagtgggagaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactataaactagttcaaccattgtggaagtcagtgtggcaattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaaggatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacattgagaacacatggacacaggaaggggaacatcacactctggggactgttgtggggtgggtggaggggggagggatggcactgggagatatacctaatgctagatgacgagttagtgggtgcagcacaccagcatggcacatgtatacatatgtaactaacctgcacattgtgcacatataccctaaaacttaaagtataataataataaataaataaaataataaaaaaaaagagccaggcaaggtggtgcacacttgtagtcccagctacttggaaggctgtgacagagaattgcttgagcctaggagttcaagactaatctagacaaacatagcaagacctccacataaggtaaacttcctggtttttaaaaattctgtgagttgagttctgcttcctcagaggggaattctaagtatctgcactttgtatctgatttatttattttatttttttgagacagagactctgtctcccaggctggagtgcagtagcacgatcttggctcactgcaacctccacctcctaggctcaagcaatcctcccacctcaggagggagctgggactacaggtgcctgccacaacacctggctaattttatatgtttttgtagagacagatttcatcatgttgcccaggctggtcttgaatttctgggttcaagcaatctgccggcctcagccactgtgcctggcctgtgtctgatttataatacaacatacgattgattttaaagctcttttttgtgatttgttgtaatttgggaccacaataattttttttccaatcccttcttcagacatacataataaaatttctaaagaagcagtattagtattattaaaaaaaaaaaagctctcagcaaactaggatttttaaaaaataatttcaactcttggccgggcgcagtggctcacgcctgtaatcccagcactttgggaggccaaggcgggtggatcacaaggtcaggaaatcgagaccatcctggctaacacggtgaaaccccatctccactaaaaatacaaaaaaattagccgggcgcgatggcgggcgctggtagtcccagctactctggaggctgaggcaggagaatggcgtgaacccgggaggcggattttgcagtgagccgagaccacgccactgcactccagcctcagagacagagcaagactccatctcaaaataaataaataaataaataaataaataaataaataaataaataaataaaataaaaataaataataataataataatttcaactcttatttaagattcagagggtacctgtgcaagtttgttacatgggtatactgagtgatgctgaggtttattgtacaattgatcgcgtcaccgaggtagtgagcataggactcaataggtaagtttgtcaactcttttctccctctctccccctctattagtcactagtgtctattgttgccatctctatgttcttgtgtacccaatgtttagctcccacttacaaatgagaacatgcgagatttggttttctgttcctgcattaattcacttaggatgatggctccagcagcatccatgttgctacaaaggacatgattttactcttttttcatggttgtgtagtattccatggtccatatgtataaaaggtaaatttctagtggagttcttatgagttaataaaaatgattttgtagggatggatctaggttaggggaacagcttgcttttcataactaatgaagcatcccaaggaagg

SEQ ID NO: 9345 - DNA, 239 bp, artificial
  synthetic oligonucleotide
gcctccaaatgctttgcctctttttggtgatgctcatcccttattttaaaattctggccctatttccaaagccttatttattggctttgaaataagagcatatttcttattttatgacacttactggagaatgtgcacctcagtgaatgatggtctctttttctccagcctttggattttgtaagcatgcccagaagctcatgtgtgaggttgctggctaataaatatgataaacacca

SEQ ID NO: 9346 - DNA, 1016 bp, artificial
  synthetic oligonucleotide
tccaaccgctttgaaggttcctgtttatatgctgaattacccttttggaatgcaggtttaacagtctctgcccaagaccgttttctgataatggctgcagaaatggaacagtcatctggcacaggcccagcagaattaactcagttttggaaagaagttcccagaaacaaagtgatggaacataggtaagcttttccctcacattcttctcaaatgtagtgggaagaatcagaaagagaaaagtgcctccatggaccaggtggcctccctttcttcttgcatctgctgggtgccctgcaaggctctggggatgcccagatgaaagagacctggtgttgctcaaggaggtcactgatagcagaaactcatttgcaggccagtgcaagagtctggatctgtccagatcacaaacacagattgtctcagcagttctccctgtaggagtgcttaccttacatactagaatgttttttgcagcattgtttgtaatagtgaaaaactggaaagaaagaatctaaatcgtaaccagtaaagcaatagtgagatacatttgagtatatccacactaaagtgtgctgcaaccactcataaaggtacagcaagtctatttgttctgacatggaaagacatctgtgatatattttagaaaacaaatctagtgagaaaaattggttatggacattattctatttaagagggggaaaaacttgcatatatagatatatacatgtatgtgcatgtatatagatatatcaggttgtgacaaatttcttgaaaagatatgtagaaaaggagaatagaaggggctgtattgtagttttgctttttttaaattggaattatggtttattggagtgttcacatttttccccccaggggacatttgtcaatgtctggagacacttttggttgtcacaactgggggatggggtacagtgggcatctaatgggggcagcatagggatgctgctaaaccactagcagtacacaggacagccccatcccccaaaaatgat

SEQ ID NO: 9347 - DNA, 4379 bp, artificial
  synthetic oligonucleotide
agacaatcctatcaggcatgaagattacctctcagaagctgagggcaaagtgcagatctctctttgggtaaggctaatccttcacagaaaagaacttcctccacctgtttataaagggcatatatgaaaaacctgaatctatgaaaacccacagctaacatcttacttagcagggaaagaatggatgcttcccccctaagatcagtaacaagacaacactgtctctcttaccacttctattaataaaagaagttcaagacaaggacacggaaaattacaaaaccccattttagtaaattcaagccttacataaatgaaaagacatgttgttcatggattggaagacttaatacagtctttcttcagtatccatgggggactggttccagaacccctcccccaccaccaccacagactccaaaatccttggatgctcaagtccctcatataaaatcgtatagtatttgcatgtaactgacacacgtcttcctgtatacctttttttttgtttgttttttgagatgagtctcattctgtcacctaggctggagtacattatcacaatctcagctcactgcatcctctgcctcccaggttcaaacgattctcctgcctcagcctcccaagtagctgggactataggcacctaccaccacacctggctaatttttatatttttagtagacacaaggtttcaccacatttgccaggctggtctagtcttgaacctcaagtgctctgcctgccccgccctcccaaagtgctaggattacaggcataagtcatcatacctggcccctcctatatactttaaatcatctttagattatttataatacctaacacagtgtgagtgctatatagttgttctactctattgtttcttatttatatttttgtcgtattggttttatttattttttaatattttcaattgtggttggtgaatcaaaaatccatggatgtgaaacctgtggatatggagggccgactgtattgttaagaggtcaacacttcccaaattgatctactgattcagtgcagtccctatcaaaagcccagctgccttttttgcagaaatggatatgtttgtcccaaaattcatatgaaaatgcaagaaaccaagagtagtcaaatcttgaaatagaaacacagagttggaggacttaacacttcctgatttcaaaatttactacaaagctacagcaatcaagacattgggcatgtatgggcataaggataaacgtatagatcagtgaaatcgaattgagggtccagatataaaccctaatgtttattatggtcagttgatttttttttacaatggtgccaagactattcagtagagaaataaggctttttaaataaaaggtgctaggacaactgggtatccacattcaaaggaatgaagttggaccccaccttacatcatatataaaaattaattcaaaatgaatcagaaacctaaatgtaagagctaaatctcttagaagaaacacaggattaaatccttgtgcttggattgggcaatggtttcttagatatgacaacaaaagcacaagcaacaaaataaacagataacattggactgcattaaaattgaaaacttgtgccttcaaggacactaccaagtaggtgaaaagacaattctcagaatggaagaaatcatttacaaaccatacattttataagggacttattctagaatatataaagaactcttacaatgcaatgttaaaaagacaagtggctgggcatggtgactcacgcctgtaatcctagcactttgggaggccgaggtgggcagatcacctgaggtcagaagttggagaccaacctggctaacatggtaaaaccccatcttgactaaaaatagaaaattagccaagcatggtggcacacgcctgtaatcccagctacttgggaagctgaggcaggagaatcgcttgaacccaggaggcagaggttgcagtgagccaagattgcgccattgctctccaacctgggcaacaagagtgaaactctgtctcaaaaaaaaacaagtaacccaattaaacgagtgaaatatttgaatagatgtttttctaaagaagataaacaaatgggcaataagcacataaagagatgctgagcatcagtagtcattagagaaatgcaagtcaaaaccaagtgaggtgtgatttcacacctactagggtggctagaataaaaaagacataataacaggtattggcaaggatatggagacattggaagcctcatacactgctggtgagaatgttaagatggtctggccacatcagaaaacagttcggtagctaaacatagaattaccatatgacccaaaattccactccttagtatatgcccaagagaagtgacaacgtatgtctacagaaaaacttgtacacaaatgttcatggcagcattattcataataacaaaaagtggaaacagcctaaatattcatcagttgctgaatggaaaagcaaatattgcatatctataaaatggacaattattcagtcataaaagggaattaagtactgatacatgctacattatgaatgaaacttgaaaatgtgccaagtgaacaaagccagtagaaaaagccatgttgtatggtttcatttatataaaatgtccaaaataagcaaatccatgaagacagaaaatagattagtagttgctaaggacttggagaaggaggcctaaagagagattgctatatgaaggttctttttggtgtgatgaaaatgttctagattagattgtggtggtggtgatggtggttgcacaattctgtgaatatactaacaaccattgacttgtataaaggggggattttatggcatgtaaattatatctcaataaagttatgaaaaatcagatttatcagattaaagtagcatagtttcaaacatgtcaactcacattttaaattgaaattaatgaaaatttaaatgttatgtaaaaaacttatagttagctaaaataaaaagatacttctccgaaccatttaatgtttatcatactgttcttagtttctgtttttttaattgacagttttgcaaatttaatgcagtatttctcttttaatttcttaaaaatgtacttagattgtcacagtgaaaatgaggtttaaaaattaagcataaataagaaatgacatgacagaacaagattgtaattaccaaacagctgtgtttgataacagaacagggcagttcgtgccactgcactccagcctgggtgacagagtgagactctgtctcaaaaaaaatttaaaaaccagtttatttttgagatttcgtaagtttcccacaattatataaactgcaaggcctgggagagaggcagagaagtgtagggttagaaaggaaggctggatccagctcacactcataataagaagggctatttctttctttcttttctgactcgctgtttgagaaggtttttcagatagagagtttatcagaaccataaggtaaatgactctttccatactattgtgcagttatttcctgaatcatattgctgtttgattcagtgtctggaaatctaaatagttgggatcattgatggatttgttcagaggccaaaaccctgataagtttattaatgaacatcagggtaatttaatcttcctgaatcttcatggaacatttgaaacccataagggagagccacaatgtaaacgcctacagaaattagagaatgttaattaagtacatcacgtaaagataaatattaacagattatagcccaaactgatttcagaagacctgggttagcatttatggtaaattaattgagactaggaatgatgagaattttaatgaagtgactggtttttcttcagctgctttcaaaattgtgaaaacctggcttggtccagaagcagtgagcttgttgaagtttacaagcaaaaatgaagtccaggactatgtcagtgtagaatacctgcctccccacatgggtggaactgtaagtatttgaaacttgtttataaaacaatactggataatggcacattaggctgtatactttcctcaagggaaaaagaaaagtagtaccataatatgcaaagaaatatcacagatacccccaaaatagcaagtagtgttacacacatttttaaagttttaaagttaattttttattttttaataggtaatatatttatgtggttctaaactgaagagtattcagaagaataatgagaaataagtcttcagtaaaaatatcacctcctacttctgtttccaaccaccatattccctccccagctgaatttcttgtattaatttgcagggatatgtattacccatataaacaagtatagtatataatttttcctccctctcatctcttct

SEQ ID NO: 9348 - DNA, 2007 bp, artificial
  synthetic oligonucleotide
atctttattataaagtggcagagaatgtggctgaattgtattctagtgttttttgggaaatagaatttgtaagtaatgaacttggatatctaactgaggagatttccaagcaaagtatggtaagtgttgtctagtttctccttgctgcttatagcaagactctagaagaaagagataaattgaggagagaattgttatgtaaaaaggaaccagaacttgatgatctggaaaatcctcagtctattcagataacagcaaaatgtgagagagtatgctctggaaagaacatcaacggtgtgactagacaaccatttggtaaagagattatggatccaatcaaccatctcagcagcagccacggatattgatagaggtatacaggaaggatctatgaagaacactcatgtctaatggctcagaaccctgtgactttcatggaaggccgacaaactgttgaaaattttagaccagtagaaacactgttaaactgagagggacagacaggagaatgccatgtgaatacagcaacacacagaatgtcatgtgaagacagaggcagagattggaatgatgcatctacaagctaaggaaagccaaaaattgccagcaaccgccacaagttaggaagacacaagaaaaaatcctctagagctttcagagagagagagagagaatggctttaccagtaccatgactttagacttctagcttccagaaaggcgagagactaaatttctattgttttaaaccacgcagtttgtggtactttgttacagcaaccctaggaaactaatacaggaggtatcaaaaacacatattgactagctgaagtttcctcttgtacggaacccacatgtattctgtacctgcttggggaacagcagataaacattttaataaacattagactacattaattaaataatttaattgcatgatttcatttaaaacatggcttaagatattttgaaagttatagtacttgtcattttggtctgtttgcatcttccttgatctccaatttcctcatttcccctctggcatgattgcaaaaatacaatatttttgtatgtgaaatccaatgaaataagcaacagtgttcttttgacaaacaccactgctcattagtaagtaatctgaattctgcttgggctttgtttacatgctgagctgataattgtcagtcattttgatatgcacagtgaacgaccatagcagtagaaattaccgaagcagaagcagaagcagaagcagaagcaccacattgattagattgaccgtgggcgtggctgctggaagcattctcaaatggtggtgccatggcatgggcttccaaatccctgtgacctaagtagctgggacctaacggtcatcaatggttccagtctctgagttcatgttctgttaatcaggcaaattttttcagctcttggaagagtcaggatttggctacattgcactcttctttcaggtctttaaaatgcaaggaattctattcatcagctgatactgatctcaccaaccattaatcacttcctcccacaaacagttgtttcttgttagggcctctggggatgtggcccatcttcagccacatacaaccaagcacctgagtgaaaggaaggccgcttagacaacaggattcctcaaactacaggtcattacccattggtgagttgtgaaatcatttgatgggttataaacagatttttcttaaaaaacaaaatagaataggatagattaaatggaatagaaaatatcagaatgtgtgtcatgtagtaaagtgtttcataaacttttttccatttattgattttaccgtgtgtgcatgtgtgtgtgtgtactgggtcatgacaaaatcctatatccttctggggatcgtgtttttcaaagtttgaaaaacatagctctagggcatgatcattagctcaaaattcccttcagtttaaaaatgaccactggccccttatacagttcatgtagccacccttctatttattcttatta

SEQ ID NO: 9349 - DNA, 1207 bp, artificial
  synthetic oligonucleotide
catttttaaccctctatttgtgctaatgcctatcctttcagtgtctcttggcctgcatgacaagggaaggaagctgaggaaaagtgcacttaaaagaaaattttccatgtctgcaataagaaagtgaggagaaggagcctcataattagtaggcaagaagcagattggggtaaaattgtccaagaggtagcaaaatcatctctatcaggcctccattaatgttgagaagttcaataccacctgagaacactatggtatcagccttgctctggctgccacctccatagtaccaatgtctccaggtttatgacataacaccagaagaatctgtctataatccaataataatatatttcatagaccatggatttagagctcagtgagtcaaacgaagtgaaatgtcagaatgcaaaaactttccagtgaagaaaatgggtcaaaggcaaaatgaagaccatgactctgagaaaagttaatttttatatggcctcagtcactacatggtgaatttctttagagaacaagcctcacttagggtagggggttgctgagggggagccagagaaatagacatgaagaagtgagagggaggaaaatttccattttcctcattgattaaagtctgtcatcaatgccccttgggattcattcaattcttgccatccttatgaaaagtcatttaaaacatatatgaaacaaaaagaacaaagaaaaaaaagcacatataagtgaaataagccaggcacagaaagacaactaccacatgatctcacttacacatggaatcttaagtcgaactcatacagagtagaatggtagttgccaggggatgagggtgggggtgtggaaaaaggggaaacatgagggtggggatgtggaaaaagggtcaaagggttccaattttcagttagaaggaatacgacttagtgatctattgcaaaatatgatgaccagaattaatgtattgtatatttcaaaattactagaaaagaagactttaaatgttttcaccacaaaaaataagtaggtaaagtgttggatatgttaattagcttgatttaatctttctataacgtataaatagatcaaaacatcacattgtcccccctaaatatttacaattattatttgtcaatttaaataaataaataaaggcaaacctaaatctataaattaaaaataaaaaagttaatttgttagtttttta

SEQ ID NO: 9350 - DNA, 984 bp, artificial
  synthetic oligonucleotide
tccattaaggaaatgaattttttaaaaattccagatatacttccccctgttaaaagataaacttaggcacattaaaattttaaagagtttatttgagcagacagtgattcatgaatcaggcagcaacaaactacaaggggtttgggctccactgacacagggtaagaagaaaacttttgtaaacaaaagtttggaagcaaaacaaagaaaacatttgatgggttaaggtagaagagtagccttagagtccctagtttgaaattagttggttatttcttattatttaagcttaagtttcatttcctaggatacgaccatttgctctgacttgggttttggtttgcttatgcaggaatccagggtgctggagccacctcaatctaatggcctctcaattaattattttaacactcctcagttcccttcccttccaaccagttcagaatcctgcaaccaacaccttcccctccttggttggacaaacacataacccagtgttttactgggaggctctggctacctccaaaatgaatacaagtcttgagactgatgactggaaactctggaattttttttttttttttttttttttttttttgagacagagtctcactctgtcgcccaggctggagtgcagtggcatgatcttggctcactgcaagctccgcctcccgggttaacgccattctcctgcctcagcctcccatgtagctgggactacaggcgcccaccaccatgaccggctaattttttctattttttagtagagacaaggtttcaccgtgttagccaggatggtctcgatctcctgacctcgtgatctgcccaccttggcctcccaaagtgctgggattacaggcgtgagccaccgcacccggccgaaactctggatttttaaagaaatagccctaacaacaacttgtcattaatatattaggggccctttggggcagttaaggggagcaagatgaagatgtgtctgag

SEQ ID NO: 9351 - DNA, 854 bp, artificial
  synthetic oligonucleotide
aaaaggctggttggaagtgaagagaccatatctagagacagtctggacaaacttctttagcaaacggtgacaacagggtttttactgtttcattttgacctactacagaaaggtaaacattttcctaattgaaatgttaaaaaggcttatgttggcataagcagggcttttgctacatataactaatattgatgtagcgccagtatagtttataaattgctttaacataaattctgccaaatcatcctgtgaacacagggatggcggccttgggccagtttctctcaaagcctcagtttattctgtaaaatggagaagaataatggtttcccatcagagagactagcacggagtaggcgagtaggccttcagtgcataataaccatcatcaaaaccataagtagcaacaccaccaccaccatgatcataaccttacggataagcaaactgaaacagcacaggttaagaaactagtccactgtcacagaagtgggccctgccatcaggtattagctgtgtggctcttggcaatgtttataagatgagaatgatgagatttgccccacctccccacctttcaaccatgaatgtcaaaggtatctgaaaactattccatggatgagaaaactggggcacagggaggctaagtaacttgcctagggcacacagctcataaatgtcacagccaagattcaaacccaggcaatgtttccacagaatccgtactcttaatcaccccatcatattgcttcaatgaaataaattattatgatggaaaaaatgctatattaccctcccctcttcatcagttatactcccctccagggcttctatgtaacattttgtgtatttct

SEQ ID NO: 9352 - DNA, 6596 bp, artificial
  synthetic oligonucleotide
gttttatgttccttattaatttttgtctcttccaaaatttatccattaacaaaatcacacccttctatggccaaataattgcaaacatttataaggacttattctgtgtttgaaactattttaaaatctttttttttttaattatactttaagttctagggtacatgtgcacaacgtgcaggtttgttacatatgtatacatgtgccatgttggtgtgctgcacccgataactcatcatttacattacgtatatctcctaatgctttcctttccccctccccccaccccacgacaggccccggtgtgtgatgttccccttcctgtgtccaagtgttctcattgttcaattctcacctatgagtgagaatatgcggtgtttggttttttgtccttgcaacagtttgctgagaatgatggtttccagcttcatgcatgtccctacaaaggacatgaactcatccttttttatggctgcatagtattccatggtgtatatatgccacattttcttaatccagtctatcattgatggacatttgagttggttccaagtctttgctattgtgaatagtgccgcaataaacatacgtgtgcatgtgtctttatagaagcatgatttataatcctttgggtatatacccagtaatggggtggctgggtcaaatggtatttctagttctaaatccttgaggaatcgccacactgtcttccacaatggttgaactaatttacagtctcaccagcagtgtaaaagtgttcctatttctccacatcctctccagcacctgttgtttcctgactttttaatgatggccattctaactggtgtgagatggtatctcattgtgcttttgatttgcatttttctgatggccagtgatgatgagcagtttttcatgtgtctgttggctgcataaatgtcttcttttgagaagtgtctgttcatgtcctttgcccatttgttgatggggttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctaatggtattgcctaggtttccttctagggtctttatggttttaggtctaacatttaagtctttaatccatcttgaattgatttttgtataaggtgtaaggaagggatccagtttcagctttctacatatggctagccaattttcccagcaccatttattaaatagggaatcctatttaatgcagtgcaccagcatggcacatgtatacatatgtaactaacctgcacattgtgcacatgtaccctaaaacttaaagtataataataaaaaaaaaagcagaatcagtagggccatggagaattcttagctaagaattttattatgggcctataatgtctatgacattaatttgatgggattttgctacgtgaatgtacagaatagtaaaacttgggtttcaaaaataaaaaactaaaaaataaataaataaatggggaatcctttccccttttcttgtttttgccaggtttgtcaaagatcagatggttgtagatgtgtggtattatttctgagggctccgttctgttccattggtctagatctctgttttggtaccagtaccatgctgttttggttactgtagccttgtagtatagtttgaagtcaggtagggtgatgcctccagctttgttcttttggcttaggattgacttggcgatgcaggctcttttttggttccataggaactttaaagtagttttttccaattctgtgaagaaaggcattggtagcttgattggggatggcattgaatctataaattaccttgggcagtatggccattttcaggatattgattcttcctatccatgagcatggaatgttcttccatttgtttgtgtcctcttttatttcattgagcagtggtttgtagttctccttgaacaggtccttcatatctcttgtgaactggattcctaggtattttattctctttgaagcaattgtgaatgggagttcactcatgatttggctctgtttgtctgttactggtgtataagaatgcttgtgatttttgcacattgattttgtatcctgagactttgctgaagttgcttatcagcttaaggagatttttggctgagaccatggggttttctaaagataaaatcatctcatctacaaacagggacaatttgacttcctcttttcctaattgaaagccctttatttccttctcctgcctgattgccctggccagaacttccaacactatgttgaataggagtggtgagagagggcatccctgtcttgtgccagttttcaaagggaatgcttccagtttttgcccattcagtatgatattagctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttggttccatttatacgctggattacatttattgatttgcatatgttgaaccagccttgcatcccagggatgaagcccacttgatcatggtgggtaagctttttgatgtgctgctggattcggtttgccagtattttattgaggagttttgcatcgatgttcatcagggatattggtctaaaattctctttttttgttgtgtctctgccaggctttggtatcaggacgatgctggcctcataaaatgacttagggaggattccctctttttctattgatggcaatagtttcagaaagaatggtaccatctcctctttgtacctctggtagaattcggctgtgaatccatctggtcctggactttttttggttggtaggctattaattattgcctcaatttcagagcctgttatgggtctattcagggattcaacttcttcctggttttgtcttgggagggtgtatgtgtccaggaatttaaccatttcttctagattttctagtttacttgcgtagaggtgtttatagtattctctgatggtagtttgtatttctgtgggatcggtggtgatatcccctttgtcattttttattgcgtctatttgattcttctctcttttcttcttagtcttcctagtggtctatcaattttgttgatcatttcaaaaaaccagctcctggattcattgattttttgaagggttttttgtgtctctatctccttcagttctgctctgatctcagttatttcttgccttctgctagcttctgaatgtgtttgctcttgcttctctagttcttttaattgtgatgttaggttgtcaattttagatctttcctgctttctcttgtggcatttagtgctataaatttccctctacacactgctttaaatgtgtcccagagattctggtatgttgtgtctttgttctcattggtttcaaagaacatctttatttctgccttcatttcgttatgtacccagtagtcattcaggaacaggttgttcagtttccatgtagttgtgtagttttgagtgagtttcttaatcctgagttctagtttgattgcactgtggtctgagagacagtttgtaatgatttctgttcttttacatttgctgaggagtgctttacttccaactatgtggaagtaattttggaataagtgtgatgtggtgctgagaagaatgtatattcttttgatttggggtggagagttctgtagatgtctattaggtctgcttggtgcagagctgagttcaattcctggatatccttgttaactttctgtctcgttgacctttctaatgttgatagtggggtgttaaagtctcccattattattgtgtgggagtctaagtctctttgtagatctctaaggacttgctttatgaatctgggtgctcctgtgttgggtgcatatatctttaggacacttagctcttcttgttgaattgatccctttaccattatgtaatggccttctttttctcttttgatctttgttggtttaaagtctgttttatgagagactaggattgcaagtcctgccttttttttgttttccatttgcttcgtagatcttcctccatccctttattttgagcctatgtgtgtctctgcatgtgagatgggtctcctgaatacagcacactgatgggtcttgactcttaatccaatttgccagtctttgtcttttaattggagcatttagcccatttacatttaaggttaatattgtcatgtgtgaatttgatcctgtcattatgatgttagctggttattttgctcgttagttgatgcagcttcttcctagcctcgatggtctttgtttttgcagtggctggtactagttgttcctttccatgtttagtgcttccttcaggagctcttttagggcaggccttgtggtgacaaaatctctcaacatttgcttgtctgtaaaggattttatttctcctttacttatgaagcttagtttggctggatatgaaattctgggttgaaaattctttcctttaagaatagtgaatatttttccccactctcttctggcttgtagagtttctgccaagagatctgctgttagtctgatgggcttccctttgtgggtaacccgacctttctctttggttgcccttaacattttttccttcattccagctttggtgaatctgacagttacctgtcttggcgttgctcttctcgaggagtatctttgtggcattctctgtatttcctgaatttgaatgttggcctgccttgctaggttggggatgttttcctggataatatcctgaagagtgttttccaacttggttccattatcctcgtcactttcaggtacaccaatcagatgcagatttggtcttttcacatagtctcatatttcttggaggctttgttcatttctttttactcttttttctctaagcttctcttctcgcttcatttcattaatttgatcttgaatcactgataccctttcttccagttgatcgaatcggctactgaagcttgtgcatgcgtcacgtagttcttgcgccatggttttcagctctatcaggtcatttaaggacttctctacactgtttattctacttagccatttatttaatcttttttgaaggtttttagcttctttgtgatgggttcgaacttcttcctttaacttggagaagtttgatcatctgaagcctcctctcaactcgtcaaagtcattctccttccagctttgttccactgctggcgaggagctgcattcctttggagggggagaggtgctctgatttttaggattttcagcttttctgctctgttttttcaccatctttgtggttttatctacctttggtctttgatgatggtgacgtacagatggggttttggtgtggatgtcctttctgtttgttagttttccttctaacagtgaggaccctcagctgcaggtctgttggagtttgctggaggtccactccagatcctgtttgcctgggtatcagcagcggaggctgcagaacagtgaatgttgctgaacagccaatgttgctgcctgatctttcctctggaagcttcatttcagaggggtacccggccatgtgaggtgtcaatctacccctactcaggggtgcctcccagttaggctactcgggggtcagggacccacttgaggaggcagtctgtctgttctcagatctcaaactccattctgggagaaccactactctcttcaaagctgtcagacagggacatttaagtctgcagaggtttctgctgccttttgtttggctatgccctgccccgagaggtggagtctacagagtcaggcaggcctccttgagctgctgtgggctccacccagttcaagcttccaggccgctttgtttacctactcaagcctcagcaatgacaggcgcccattccccatcctcgctgctgccttgcagttcgatctcagattgctgtgctagcaatgagtgaggctccgtgggtgtgggaccctccgagccaggcgcaggatataatctcctggtgtgccgcttgctaagaccattgcaaaagtgcagtattagggtgggagtgacccgattttccaggtgccatctgtcaccccttcccttggctaggaaagggaattccctgaccccttgcgcttcccgggtgaggcaatgcctcaccctggtccggctcacgctcggtgggctgcacccactgtcctgcccccactgtctgataagccccagtgagatgaacgtggtacctcagttggaaatgcagaaatccctcgtcttctgcgtcgctcaggctgggagctgtagactggagctgttcctattcggccatcttggaacttctttctgaaactattctaaaatctttatgtatattaagtgattttatccacttaacagctctatgaggtaggtac

SEQ ID NO: 9353 - DNA, 1360 bp, artificial
  synthetic oligonucleotide
atattcttttttaactcattaactcctgcttttatctttattaattcctttattctattttcccctagtccattttgttgtttactgataaaaatattaaatctcattctgagtatgtctctagataggtcatataaattgtggtataaattgctttattactattttgtagacactgtgcaatttcagcttgtatttcttctttggttcaaggactaagaaattcatgctttccccagaaagcaaaatctttttatttcctacattttgttgttttatttttagttttatcacattatgggaaaatatttgctatattgtttttaatttttgaagtttattgagattgtctttgcagtctagtacatggttgatttttatgaatattctatgggtacttgcaaagaaggcatattctttatttacagaattcagaaaataccggttagattttccgtgttgcttatgttacttagatcttccatttgatctcccttcagctgtcagcttactagagatttccatagatattttctcaaacttgcacaacctgaggccagatgatctccttttctctgcttttctagcacctgtacttcctgctactttaacaattcttgcattgcattataatttacttgtccatacattcaaggtccttgaaaacaggacctgacagctgttagcacatagaatgacctcaaaatcatttgttgaatgaatggatgagtattttataactttctcccatttagaatttctctttaaagagaaggctggaggggaggggtcagggaaggagacactgggaagaaaatattatagatacattggaggtgtccggcaaatggaaaatcttccaaacaagttctataattctcagtcagacactggcagcctaacacattggtactcagatatggatcagtagcacgccatcagcccaactgcaacaggaaaaatggcaaatgggccagtgttcatcaccagcattacctatttccctaattttgtaccctgcctctgaagacaccactaatctcatattattattctggcttcaatgtttagaaacttcctcagtccttttctcccttttgcaatgaaaattccaattaggccagtctcagttgagtattggttttattaaagtaacttgcaaggagttgtgactgactctatcaacttaatttttcagggcatattttctttgccaaatgggagcctgctaatctaaatacatcttctgaatagctcttccactttcatgcctaatcatactttgtgaatgcatggaatcagcatagtttattggaggcggccatatacaatcttgccctttccctttcgtttcctcatc

SEQ ID NO: 9354 - DNA, 2787 bp, artificial
  synthetic oligonucleotide
atttgagggaaagacaaacagaagaaaataattcagttcagtatcggcttttcagtttgataaaagcaatttctttcctacttgcttatcttctacctttctagtgctgaactctagtactaatcacagcactttaacgggtgttgtaaatgctgttcacggttggatctctgaaaacataatacttaagccttcatcttcaatgtgaagaagaatttggatggtagcacgaataaaattgtggcctgcacaactttactatatggccattaatgagaaatgttggttttaaaaaactgatgtgacttccatgatccatattaatagcataggtaggtaaagatgaacagaaactccatgtttgctctgtgcatggtttgattaattgacttgggtagacaaatgatgattgtagggtggagggtatatatttccttgatttgagccacaaaccctctttacatacagatcaaagtgtctaatacatagtcttcctttccttatactagtaaaggtgagaatttagttgatgctttcatttttctcttctccattcctcatggctgcacatggttcatatttttattgggttctacttcccagtatcttcctctgggatggatcatctatttgtcaacagaaaatgagaaaattatggagaaatgacagtaaactctatgttccctcctttcctctgagctcataattagacaccgtgcccaaatatacgtgcaaatggcagagccatttttcaaagcaaaatactttgaacatagatccaaacaaaacacaactctaaattcattatctcacctctttgcaattaacctaaaggagaaaccagagcaagaacacaccacagctttcggtggagtccacctggggcttgctggacttggtgcatcattagataacttgttttcccacagagtgagatagatgtgccttgaacaataattaaagggctttcatctgttgggttaattaaaactgcccatttgtttgcctattcccatgctttgctgtcttccttgtacaatacctccattgatcctctgtgagctgagaagtatcacaaatttagtctacaaaaaattagctcttctaccttccaacctgactgcatgaatacaccattaaagcacttcctctgaaaaaagtggagacagttggacaatgctccagaagaccatgattaagtagttagggaggggaattacattatcctaagaaataaaaatagccaatttaattgcatgccaattatgtaccaagccctcttctaaaaacgatttctacatattatgttatttaatgcttaacacaaccccatatggtgaagacactgctattatacatgaagaaattaaagcctacagagattaattgtctagacttagactgcatagccagtaagtggcagggacaagatgagaacctagagatttataattctgaagccatgtgcattatggctccattctaggttcctttaattggcacaaaatactgtacttgtattgactgcttacttggtactgggcattgttttgaattctttacctgattaatattttaattaactaatttaatcaaacaacaaatgaggcagggactgttactagcccattttatagtttcataaactgaggtaagagaatctcagtaacttgctatcttcagaaaggacgtatggcagaactagaatttgaattcagaaaatcttgctccaaagactgcacttttaactgctacctctccctgtatcactaaataactaatttgaacctttcttgtgataggaagtcagcaaagtaaacttaatttgaggagccagtctcagtctcataccagtccagtggacttgaaagaggataactgggatgtgcaggtagacatacgatagagaagacttagggtgatatagtccagaggtgggagtttaacaaaggtagagagaatcaattagtggagaaaggtatgtatcccagtggcaataatttcacagctttacctagggaggcacgatcttttaattgtgttaaaaataagaagtgacagtttactctgggcttccactttcccttcttgccgtatgtgtcccaggaccttgtaaaagacagtgacaaccaccttggggcagggctttacaactgcaaaacctgattaaatcaagcaaaataggtcaacattccgccttcatattagctgtacagagcctgacacggggaagcatgaacagatgttgggcagtgcacagagggatccaaaagcatctaattaaacacagagaaaagtgcagaaggaaccaggagagttacaagctcagggctcaccttggtacagggagattcaggagccaagagccattggaagtaacaccaatgtgggtgccccagaacacatttgtcccaaacatttgtcttcagctgtggggctgacagatgcatgaatttaagctaaagactgatttcaatcatgcttataagagtttgtataacatgttaaatttacaaatgactttcccatccattgtattattaatttccagagcagccttcaaagacaggcaggagtagatctcctttacaaaggaggcaattaagggtccaagctctactaccagtgcttggcagtaccagagtcggaatccatttcttataactcccagtctgtgtatacataaggctgaacagggcaatgtggagaaagggaaaacaggagaccaatgggaccctgctaatagaggaaaacatgctacaagtcaggagaatgggtattaagaga

SEQ ID NO: 9355 - DNA, 2006 bp, artificial
  synthetic oligonucleotide
cacaaacattcagtccattgcacacccaaagtgtcatcacagcccaagctttctttaccataccgctaagattttaccatccatgaatttactgatagtttcacaaaatttgactcagaaaaattggtcaaaaaaattaaacagaaacagattcttccctgaactgtctttagttgtagtcagaatccttagctttatgcacagtgatgaggtcattgaggacattgattggtgctattttctggggtaatagttttgatttctctacattttctggaataaattatgtcaaagaatgcctcagaattttgagtttctaaacctgttgactttcctctcttcccttacacttcactctcaccccattatccaaatagcattattaaaagttttagtttggggtatttgttcccagatcaaaggcaatgattatatatttcaagaagtcaagatggctttctttgttgctatccagtctgcccttcctatggttaatgaagtcccactaatttattgtaggtgttgcctgcccacaaagtagaggcctgcttacagacccaataccaattctcactctgatatgttagtgtcagagatgtgtactcacaggacaacacatttgtgttactctaaggagtatttttatgtatcattatttttatggatatattattcaaaaatgcatttttgttcattaagacacacagaaatctgttagtgttcattgctagttgccccagcattaagagtattcagtggaacaaattttgtgtggtcccaaagacttagatgactaataaggagaaaatgataagataggttatattctgtttttgaaatgtgagtttaccgttttcttttatttttctcttttctttagtttctgacggcaagtgaatttacaggatggggagtatatttgcaacccctatttcctgatataaaggcatggtttgagaattttagtaatgtcagtaagggtcaagggtgctttcataccatctgtatatagctttcccataagtttgggccatcagaaaatagagaaaagatgctctcttcccagcttccaaatgactgcctggaaggatgtaggtagatagtgtgtgatttggacatatggatgctggaacactatccatgctacagcagtggatcctagtctgctccttatttaacagataggagggtgaactcaaagtgtacaaaatgtgtctgctcagagaacatctccagaatataattctagctccctcaaatccttccccacaacagacatttcacatgctttgctggttacttctgcagaatgaagagttgttttatctccaatctgaaatcacattcctgaagaactcagattaagaagatagacagccccttattagaatgcatgttgtgctgtaactgctgaaatgagactgtgggtcccctttcattctatagctgcgtaaacaagttataagaagatgctgacttatcagggatagcaggtagctacatttcttatttttgacttcttaaggaagaatcaagaatctattacaagcctgacttttttttttttttaatggagtctccctctgttgcccaggctggagtgcagtggtgcaatctccactcaccgcaacctgcgcctcctgggttcaagcaattctcccacttcagcctcctgagtagctgggtctacaggcatgcaccagcacacctggctaatttttgtatttttagtagagacggtgtttcaccatgctggccaggctggtctcgaacacctgacctcaggtgatgcacccacttcagcctcccaaagtgctgggattacaggcatgagccacagcacctgggccaagtctgacattttttaaacaaacatataaggtgaccttggtctctaaattagcagtgcaatggtaaagcctcaatttatcataaagtaactgccccctataacttcaaactcaaggttagctttcccatattaaagctcgcacagacttgagatt

SEQ ID NO: 9356 - DNA, 4097 bp, artificial
  synthetic oligonucleotide
aaggcaaagaaataaagatgacataataaatagatcctaaaggaaagctaagatcaaaaataaactcctgtactttttttagaaaatccatagtgcagctgctctggggtgcctgattgcctatatctttatctgaatgcacagaaaaaggaagctgagctgtcacccaagggagtgcagagctcaaaatactagtatccttgatattctaggtctctcatgacccttgaaactctcctaggccttctcatcatttttggataaagtgcttgcacttgtacatgtctcacaaagatctctgtgtttaggttctttactacatctgtctgaggttgagtttccaagaagcagaccctgtgcaaaagagatttattaagaataagcaatcaggggagacatataagagagtgaggaaatgagacaaagaagtgggaaagccaagcatctatattgtcaatttcaacatcttcattccacatctcaagccacaccttcccactctatgttccagcctcgatgccccatttgccattcctcaaaccttttatttctggtgcttggcacttgcatttctctctaccatccctgcctttccaacagcttactctctactctgacttcaggttaatgtcatttcctctagaaagcctctcttaaactacaaatcccaacctttcctacgtgctcagtctagagtctatcttgtgattagttgcttctctatttctttccatcctagactagttcaagaaggttaggattgagcttatctcattctacattgtatctccaacacgtgacagtaggtaggttgtcaatagacatttatcaagtaaatttaaaaattgataacactaatccttaatctcagaatctgtaccaatgcaaacttgaatattaagaactgaactaagttattattatctgctaattattgtgattcacttaaaattcatgaagtccctccatatgtatcatctcatttgactcctcactgcattttcttgaatagaaaacagccagaattttatcattcttgttatttaggggaagaaaaagttatcctgctgccaaataggacttggacaaacactacctttccttatatataacctaggatggaggggagtataagtcattagaaaatgacaacagggacactcattccccatctgcaatactttattgaatatatttgtaacacagctgctgccctttctattacaggttgaattgaatttatctttgaagccccaggtttttgtgcactttctgtttatctaggagcttaataaatatttaatgttgagtaagtggatttatttacatgtagacatgtatcacgcatttattatgcataggacactgcgctaagtacaaagtagagggtgattcaaaggagaattgttaacttatcagcattctaacctgcaactttactatcccaccttcttctactttaccactatttcagtaccaatatcccatttataaaaagttttcttttccatgcctaataccgaacatggatggatagtgacatctaacttatccaaatagaatccctggcctaaggcactctcctactcagtgtctgcagtgttcagtaaataaaaccaaaggcgcataaatcatacatgttgataatattggatatacctgaattgccagggagttctgactgctaaagtaatttcaggttcacttcatggttatggcccatacttccttccaaccagtgagtctgtggttgggcatcttctgaaattctcctcttgagcttcatcttccagctttacaaaaaaattgagtagttctcaagtacaggattctcccagattatgaggcagtgaaccaaaaatctttacaaaagactaggggggctaactaaggtatccactaatagtgatgacctttatttttctctagagggcccgtggtacaggagaactcagttcactgaggaggaaaaagaagtagctctaggctttataaaagaggaggtacttgaatttggtattgagagcaaataggtgttcaatgaatgaaaaggggaatttcagatagagaactgtccatgtctggaaagaacattgctagtttgggggataataaaagatgagtatctctagaggaagtgaaagggataaatcatagaagataagcctacagaataaagttagttaaggccagaatgtaaagaagattattgaagcatagatttaaccacaggtaacaggaaggcaatcaaggtttttaagcagaagaggagcataattacataagatttctaagaagataactcaagatacctttcaaaggatatacgaaaaaggtaagggaccagggttccaggacaatcatccacaaaagagagatgatgaaggtttgggcttagggagtggcaatgggttagaaaacgggcaagattcacaagataaacttaaggtaaaattgcatcagacaagatgtagcgggtacaatagaaagagtaatgtttgactcaaggttccattttgagcaactgagcagacagtgattttgtttattcatgtcagggacacacgaggatatctaatctacagttgaaaattttaatctggagccaagaacagataccagagctataaatgtaggaatagtagtcatcatataatgacagtattgctaagatcacccagtgagaatgtgtagaataaatatagaagatgaataagaataggatttccatgagcatgaacattgaaagaataagaggaagagaaggactcaacaagggatacagagaaagagtggttagaaaatctggaggagaaccagaaagagatgcagtcattgatattaagggaagagggagttttgcagatgaggaaagcaaccacgacaagtgcagcaggaatgttgagtagaaagaacaagagaggtcattggatttgaccactgggacatttttgaccttagcaaggccaatttccctagagtggtgatacaaaagcccatactgagttggtagagtaaatgagatttgagaaagtggggaaaagtaagtctgtagatttatcgtttaaaagattggtgccaaagagaaagagagggattgaatactagattacagaatttgagggaaaggaggtttttttttttttaaaattaagatgagaagggtacatttgtagaataaaggaaagggagactgaaagtacgagtgagatagaggataattgatggaggagagttctggaaggagcaggaggaatcaatctcataaggaagatgaagagattacctttgcactgaaggaggaataccatttccttactctgataataagttttacaggtggaggggaaggtagtcagataagttcacatccaatgatctgtattttcttggtgaagtagtattctgtcatctgccacagaagggctgctgccacaagcatgggctggtcctgggcacagtcaccatgaagctaaaaaagagcatcaggcccttgatgctttgatacctgccatctttgccgccaggacagaccacaaagattcaaaaagcatttaaaaattttaaacacatcatgaaaacagacttttctaaaaaaaatttatacttctcagttggcttattgagtaggaagatattttatgtatttcaaacatatgtcccagaagatcaagccagaaggtattatgcacaattctcagacaaaagatgaacagaagtaaagggacttagtgtccaagttatccatcagctcacttcttagccagtgctttattcctcactgcacccatgcgtatatttcacaccattttcattgtaggaactcagaaattgttaataataacattgttggtttatattaatgagtccttactatgtgtcaagcatttaagcactttgcatattaactcatttaatccttccaataaccttacagagaaggttattatcatccctatttcacagattacaaaatagaacagaaattgtatttggttgcttatggtcatacagctagtaagagtgcagaaatggcttttgattccaggcagtctagcatgagtctgccctcagtgctattagtgggatagtaaaaa

SEQ ID NO: 9357 - DNA, 1217 bp, artificial
  synthetic oligonucleotide
aattaaaataacggtgactgttaagaagatagaagggcaaaatttgaccaccagaataaaatcaagagccaaatatgggccactgaggtaaacagaatggttattctagaattcttattaaatattagcatatttctctgttttccttgctgccctgcattggcaagggaaaaagaagtgcataagtataatttttcttattggaaagaatttttcctgtatactttcaagtcagtaaaatattgcatgtctattccatattcctgatgggctttgaaagatgtcataatgggcatatatataagaaggaaaaatggatgtaagctagaaaagataaccaccagaaatgattcagacttagactctgtaattgagagacattcttagaaactacagggaaaaaatagcttttctgatgtgttgaagcacaagtgtataaacaaagtcatgagtcagagttgtcaattgaattttatctataagatccatagagacgtgtttcagatcttgtcaaaacatacatttaatgaaaatcctcaattcagataaaaacacaagctatatccattcacaattacctggttctgaaaccatggtaaatgttgattctatatcaagagatgaacctctttccccacttaggtgatttgtctcattttcagttgatttatcatggtgttattccatcatcctatcagatattcttctgtcagtattattgtatcttgaaaatgcactttaaacattaggcttttaatgaaatgttcaaatctgggcaaaatgcattagttccatttctttctttttgaaacaaagcctttatctattttaatgaaattttctttgaaaataaaattaacttagcgttacatcctagttttcatcccaatgtgaataaatacatttcactaaaacattctttttgggatagaatctagagtagataatgccaggagataattattcattccacttctttgtgcctgccatgcacactatttttttcccacatctagagacctaagttagaaagtgtaatgtgtgacattaaaacctacatttgcctgaaatatgtttttctgcaatttccaaagagctagcagttcaagaggtgtttcaagtatcatagatccacttccatgaaaccagaggttttcagattttgcccctggaaaatgatcatgtctgtagtcaagtggagctaaagttcaaatgtt

SEQ ID NO: 9358 - DNA, 1673 bp, artificial
  synthetic oligonucleotide
aatgaatatttcaattagtggtgaacttaatcaaaaatgaagcttaaaaagaagtctgagagataaatcccaatccaagaaatgagtaatgggaacagatgtaaatattcagtttctcaaatgagtatttaaaagttagaggtgacatcctcagtctactttatataggtttcacacagctttttcacatttcaactatagtcagatcccattattctaatgtcatgtttatcatgaaaccttccaaggcagcatgtacctaggaagcttacacactgcccaggcctatgggttacttggcagcccagtggctatattttcattctggcttatatgtcaggttattaggtattatagaattagtatgtcacattcctgattaataacatatttgaggctctaacaagattaattttataaacctgcaaggctaagaaccaggatttagactgtgaagaatacgtggatgaatgccacattttgaaacgtcttgggtatcagtaagctgatctccctagatactgtaacctagagccccactttcataatatttattttccttattttcacatatagataggtcttaagtccctacaaagaagaaataatgcttcatattactttgtctaatcttcaaagaaataacagtattttgcataaagtaaatgcctaactaatattcgttgactggttgattggtataggactgttgggtacacatgcactaatgagttagcatctatattatgcttcaaaataataaagtcatcattgtctataatgaatgtaattccatgtcagctacaaaatgctaacttacttgcaaatataaaaatattgttcaacttcaaataattcactctttccaaattcagcttcttttcagcattctcggaatccaaggcaatccagaagaggcattttatggaatgggggttagatactcatgaagtcaataacaaaagtttcaaatgtgagaactccccaaaatacattttcagcgaaggtatcatgataacgaaggtgatgtcaagggatttttcacatcagtggcagaacaaaacctagaagattctaagacaagtgctactgcaacaatcaatctcattgttattcattattatcatctttagaattgtagcaaaggagaaatctttctaatgcatccaagtggaattacattttatttattctccaaattactgtttgtcctgttaatgtttatgaaaagaaacgctgcatttctcacattagccaacagggaagcaatcacttgccatgaatcatcactggaaatataaattgtttcaagcatttgacacatttatggcctgtgaacattgaacactaataagcagaactccagtcctaaaataatttttctgacttctaaacaatttaatccagaaatgttctggacagacatccaattgcctgcatggagcctggaagagcagtgatttcccatttaggcttcatgtccttgaagcttgtctctctgcatgatgggcatctttatgccttctgcaaaataaaaaggagagaagcaagctggacttttgaaaattagagagagtaaatgcagagtgacatcagctctaagtgttcttgctctatggacattgctggccattgaaaacagctttaaattcatcagtaccaatgcttgtagc

SEQ ID NO: 9359 - DNA, 2072 bp, artificial
  synthetic oligonucleotide
tttttgtctcatggtattgctgataggcaaacagtctgatgcagttctcctgtgttgtgaagacgagaccaagctcacactacaggactggaagcttctttaggtacaatgaggaagaaggaagtctccactcttcacccccacacagatatgtctagatctgaaggtatttcaatatctgccatgcactggaaatggaatcagccttccttacaaccttgaagaagggcatagcttatccatgttcaagaagtgttactcctgactttcatgctgcttcctgcttcctggttgagctgaattctataactgtgctatccccaccagcgaagtgagaaaggagggagagagaggaagtgctggggtggagttcactgtgccttccttacatgaggctggaagaaactaactgataaccccacaaacccactgtcttctgcctttttgagcctcaatgacttgtccctaaccttgaccctaacctactccaaacttctgtggtcataagcattggtcattcctgattgagatgactggatattttaatatacaatgtcttgccagtagaaaatcacagcttaaaaaatgttttctaaaatctttttttctcatatccgcaatcactttattatgtttggaagtaaacaagttttagaacagccatctctaaaatcaactctggggctttctttaagtatatagttctattattgctaaacagaatttcaatgggcaattataacaactgattacttattcaaatagccatgtttcctgggcaaaatcacacaaataagttgagtgctgatgcaccagattatagggcttggtgaacaatgctgtgcacctcttttctttccaactgcctggtacagttcttgacactggaaaggaacaagacagatatgcagatcacagtctaaaatggtgagacaggcaataaataaataatttcacacatggtgagaatgaagaaaacaaaagggggttatgggatagggtgactaagggtaggaatttctttggctaggaaaatcagaaaaagcccagaaagcagccatgaaagatcttgaggaagagaatgtatgctttaccagggaaaacatttttgtgtgtatagttcatataaactagaatagtgtctgaaacatgtaagaaatatttgtagactgaattaataagggttgtttcaggcagagggaatagcaaatacaaaagctctgagatagaaattttagtgcagacggaaaagagtgaagggagagtcaaaggagatgactttggagaggcatataggggatatcaaattttgtagcagctattggttattgtaaaaagtttgagatttattctatttataatgaaagcccattgaaggttgttgagcagtggagtgatttaatcaggatttttagtttatgtacccagttgccaggggattctccatagaaacagaacccagaggagacttatatatagtaaaaaattggctattatgacttctcagctattatggaggctgagaagtgccaagaactgtagtcagcagactggtgacccaggagagctgatagtgtaattccagtctgagtctgaaggcctaagaactgggagagctgatagtataaattccagtccagaagttggcaggctcaggacccaggaagaaccaatgttttggtgggagtctgaaggcaggaaaaaacaacaacaaaaaaaaaaaacaaagtcctaactcaagcactcaggcaggaggagttcccttgtatttaagaaagggtcagcctttttgttctattcaggttttcaactgactggatgagggtgacccatgttagggaaggcaatctgctttactcagtctaccaattcaaatgttaatctcatcccaaaacatcttcacccacaaacacagaataacattagatcagatatctaggcaccccatggcccagtcaagttgacatatgaaattaaccaccacagatgacttggcatgagaaaggtgggtaacaagcttggagggcttactacatgcctgggctcagccctgccatacaagagttaggcat

SEQ ID NO: 9360 - DNA, 318 bp, artificial
  synthetic oligonucleotide
cactctctggcctttttgtttctttaatgtgccatgctcaccctagccacagtgccttaatacatatggtgccatctgcccatgaaactccattcccttcctcacctgcttagttgctgctccccatcagctctcagctcaaccatctatttcccggagaaaccttctctgactctttctccatattcttcctttgcttttaacattgttgtaattttacattggctgtttatttcattagtgtttttctctacttactctctgggttgtaaactccaagtttacattagtttttgcctatgaatatattcctggctc

SEQ ID NO: 9361 - DNA, 3630 bp, artificial
  synthetic oligonucleotide
tcttcattgatcttccttgtcctgcacaggaattccagccaggggagttggcatctctgaggagttaggtgttccctgtggactctgggaacctaccactattactgtgttgttctttctccagctccttgttgacacctgtgaattaagaatcatcacaagcaaagatgaacttgtcagccaatattttatctccactgaatgcactacaagctcagaatagctctgagggtggccgagacaacttggccccagacccagttttgcaagacttggtcatgtgagcatagacctgaattgtaggtaagtgtcaataccatgtaatcatagtgtcgcccctcaggcatttttccttttttctcttttatttgatcttgattttattcacatctacactctctactttggttcgagtcccaaggaaccaaatctggaatcataaaacacatccatggaaaggaaaacggggtacaatataggcaaaattaggctctgacctttattcttgaataaattctgttgtgaattgcaattaaaatcactctccatagaaacaaatgcacaaagagaattgaaaaaaattagaatttaaaaaaactcactcctccaaaaacgaaaccaaatttcaaaactcaaattaaccatccaaccaatcaaatacaaagcaaaattcagaataatcttttctgctgtcctcatctctcaagttagagccctgatttttgccacatacaaacatcagtttcaggtgtgctaagacttaactacgaaaagtaaaacagttcctgaaaaacagaaaaaaatattttcataatcttgacttggagccctctgccctcctttaaagcatgtcactgagggtagaaacattaaattaaaatacagagagattttacttcattaaaaaaacacaataaacctaataggtggctaaaaataccataagttaaaagaaaaatagtagcccacagaagaagctgcaacttatatgacagaacaaaaccagaggatttaatatctataatatgtagcaagagtcttacaaataaataaaacaaatgctgaatacaaaaataagcaaaggatggacataaagaagcaattctttttgtttatggttttttttttttttttttcgagacggaatcttgctctgtcacccaggctggagtgcaatggtgcagtctcggctcactgcaacctccacctcctgggttcaagcgtttctcctgccacagcctcccgagtagctgggactacaggtgtgcgccaccatgcctggctaatttttttgtatttttagtagagacagggtttcactatgttggccaggctggtcttgaactcctgacgtcgtgatccgcccaccttggcctcccaaagtgttgggattacaggcatgagccaccacgcccagtcaaagaagcaattcttaaaagcagttcaatgtcaaatacatatgagtgtatgctcaagtttgttaatgaaagaaatgtgaacttaagtaacttaacataaacttaaataagtttgcatttctttcattattaacaaacgttgacttatcagttattaaagactaaaaagatcaacaatacccgggattggtgatggtatgaggaaaagacaccctcccacacattagtggtgggaatctagaaccatatcaaatttggggtggacaattcagcgacattcatcagtgtgactaatagacataaccttttacccaagcaatttcacttgtagaaatttatcctgacaacattatcaagcaaatggataatgatattggaagtcttatcataacactgtaagagtggaaaaaatggaaacaacttaagcgcccaacactaggggattggataactgaatggggatatatctgttcaatagcatatcatgcagatgaaataaatatatagacatgaaaacatgcttctgatatattaagtttaaaaactggcttttggcatattggctatagtgagatacttattttcttaaaaaaaaaaaaaaaagaacctgaagatacttagtcaatggtgattccttctggggagtggaattaaggaagatgctgtcttttctttcaaggcaatggaaggcagtgtttaagagacaaacttctggagtcagactgtggagtttcaaattttgtctctgctgtttactagcttcctatctttagatctttttcataattgtttttctgctctattttctcatattccaaattgggcatagacacagtgtctagatcccagggcctttatgaggattcatgtgtatatgtattgttatatttcagcacactgttaccaaatagccaggacttaatacattttagttatcattatgacatttttctatatgcctttaatttttacaacaaacatgaattaccttaatagtaaaaaaaatgcatgtacaaagtggccacaaaacctaaaaatacaggcaaatatacatacataatggattgtcgatattatatcacaatataataacatttatgattcctgactttatgactacctgtatatttattttctagttattcaacaactgaggtgaaatttacataacataaaattaaccattttaaagtgaacatttcagtggcacttaatacattcacaaggttgtacaaccgttacctgtatctaattccaaaatagtttcatcactccagaacaaaagtctgtacctgttaagtagttgctcactattcccttcttcccgctgctcttggtagccacttgttgatggacatttgggctttttctagctttgggctattgtgaatggagcttctatgaacatgcatgtacatgtgcttgtttgactgccttttttcagttctcttgggtatatgcctaggaattgctgggtcacacgataactctgtttaactttttgaggaaccaacaaactgttttccacagtttacattttacatttccaccagcaatgtttacatgttccaatttctccatatcttctccaacacttattcttttccatattttgtgaatgtgaagtgaagtgggatcttgtggtttgggtttgcatttccctaatgactatgatgttgaacttcttttcatgtgctttttggtcacttgtatatattcttcaaagaaatgtctgttcaagtcctttgcccatttttcagttgggtcgtttgcctttttattgttgagttgaaagagttctttatgtattctaggtatatatttacttttgaaaacaaagagtcttattctttgaagattcaactcaggtcctccaaaaagcctgatgtttccaggtagaattttatttcttcacaatcagagaacatgcaacaaagactgtgtttgtggcttgcaaagtgtaaaatatttaccgtctagttctttacagaaaatatttgctgaactataaactccttgaggagagggataagttgtctgagggcagagccttaaatgttcaaaatgatggcccttaggtactgaaaaatctagtgttttgcgtttaatgcaaagtgaaataatatattttggaaaaaattcttttcaaggtgattatgactaaaaagttctgaactttcaaatttatttggaaactatatgaaacagctca

SEQ ID NO: 9362 - DNA, 496 bp, artificial
  synthetic oligonucleotide
tggagtttacttatatgtatatcataattcatccagtagtacactaagaagccaaaatgttaaccatgttggaatggaatgatcttgttttcttatttgagatatctgtgttttccaagtttttcccagtgaatctgcatttcttggataactagaatatatttttaagacataaattgtgtttcgttgtttgagctggcaagctaatattctttaatattttggctatttacaaatttatgtccatacaaggtcacattttctctggatgtacttaatgctctaacatttgtattagcatattgcctacagaggatttcaaagttccaatgaattatagatttcgtatggctggaaagtaacttgaacaataagctgacccaaaagattgatgtctgtagcactcaggaggggtggttatttattttcttctggtatacatctagggatagagccaggctttaccacttctttagccaacttctttcaatacttt

SEQ ID NO: 9363 - DNA, 1222 bp, artificial
  synthetic oligonucleotide
atgcataaaaatctgcatacaatttcttcttaagtcccaggctgatccctgaattgaacttgccttaaggagaatccaagggtaccagtgaaaggaagctgaaaggctgaaaaatgtgagcagggatttaagcctctgcccaaacaaggaagataaagattggaatttgagtcctgccaagttatgtcagcttggtatgtactttggattttctttgaaaccacagaaaggccatacttagggtgttaaaactttgtcataggactaagatttaccctaaaactaaggacaaatcaaaacagatctaccctgacaaagtataaaatgaagtctccataagttcaagattatcagccagcaatttaactacatggtaaaacaaaaatcaataatattttacagagagtaagagagaccagattctataaaacataccatccacaatgtctaacatacaataaaaatacaagatatgcatgaaaacagaaacatataacctaaggtcaggaaagaaagcagtgaatataaacagactaaattcatatacaggaactttgaaggagctattatgctcacatccaagaacttaagtgaaaaaaaatcataacaagtaaacagatggggaaccaaagcagagaaataaaagctataaaaaagaacgagatgaaattctaaaagtgtaaaatacaataacagaaataaaaaattcaccagatgggcttaacagcagcttggaattggcagaagaaaggatcaatatattttaacgaaaaatcaatagaaattatccaaattgaagaatagggaggaaagaagattgaaacaaatgaacatgcctcagtggcaggtgggacaatatcaagtgatcttacatatgtgtaattgtgtctgagaaggattggagagaaagaagagaagaaaaaaaatggaagaaatgatggctgaaaagttcccaatgctgaagataatcaatttacagagccaagaaattaagtgaacactaagtagaaaagatgcaaataaaaccacacctaggcacatcatagtcaaactgctgattatcaaagataaagagaaaatgttaaaagcagctggtgggtagagggacacatcagaaaacaatgatatagatattggccagtttctcatcagatataataaagacctaaagacaatggaatgactattttattttattttattttattttagtttagtttag

SEQ ID NO: 9364 - DNA, 645 bp, artificial
  synthetic oligonucleotide
ttctacttctgacttcctgtgacccattttcaacacagcagccagagggatgttcttaaaatataagagtgaatttttggccaggcgcggtggctcacgcctgtaatcccaacactttgggatgctgaggcaggtggattgcttgagcccaggagtttgagcccagcctgggcaacatagtgagacccctgtctctacaaaacaattttgaaaattctccaagtttggtggctcacgcctataatctcagctactcaggaggctgagttgggagtattacttgagccaaggaggttgaggctgcagtcagctatgatcatgccactgtactccagcctgggcaacagagtgagaccctgtctcaaaaaaacaaatacaaaaacgaaaaacacccatatatgtatataatctaaaagagtcaatttccctcctctccaggggttcccaactcattaaggcactgcctttaggacagctgacaaagccctgtgggatctgctgcccctcctatccacctatgctttcccactccatctgctccagtcacactggcctccttgctgtccttcctataggccaggcattctcctgcctcagggcctttgcactgtctgtttcctctacggagaatgcttttctctcaca

SEQ ID NO: 9365 - DNA, 1633 bp, artificial
  synthetic oligonucleotide
agcccttctatccttcccactaacataataggaaaaactggtattcacagaactaaaagcttagcaagagcaaaaaaatacccgaattatttatttggttctttttaattttttttctttttctcttcttgtgtctttcattttttaaaattgggctgagtgaggttttaggaatttgtatctacttagtactgtagatgttggaagggacctgaaatagaccatgcagcccaacacataactttataaagaagaaacagagatttagagaaatttaaggaaaaaaaaaaaaaaaagaaagaaagaaaaggaggttcaggaaagtgcctgcccaaaatagcacaaccgaggagtggcaggatcaaggttacagcctgggtctcatggctccctgtccagcaggctcacccctgcccaaggcacgggatttttaggcatatgaatgcctagttcataaggaaggaatgcttgagaaatgccactattatcacaattagcaatatctgcaaacgagtttcaggtaggccgatttaatagcctataaatctaggaattaaattcaacatcagacagaaaggaaagaatacattgctttgtctgacagtttttctaaactcatcatggcagagtttcctaaaactccacagcctcctaccctgtaaaaatgcttgcttatttctggcagccaattaaaaccaaaatctgatgctataacagaaatcggaagctggaaaactggtgcaatatccgattcagaaatgagcgtgaatgtcaagaggcctctgctggcattcttgcggcccagcccgggcactcgtggcttggagtcaggctgtctggtgtaattaaaagtcatgctatctgttgggggaatggcctgttccaggatttgaaaaaaaaaaaatgctgtaggaaaaagctccatgaaatgtatctattccatggaatttcatgaaatatatctgcatgataattggctgacattatggagggcaagaggcaaacatcgggccctgagaaatcctcattaacttgctttgagaaccttccaatgaaaatagaaatagggcttccttccagcagaagccttaggactagcttcctctgttttcataggcagcggaaacagcaatcttttgtaatcgtttcttttagaaaacaaaaacaaaaacaaaaaaaaccttggttctgcgacgtaataacaaaaaaagaaatagtgggacaaaaaaagaaccaacacactgagataaaagacatggcacaattgctatttgatgttttctgaaaagtatcatgatctgcatggatttttacttcttcaatcctcatgatagttgagactgtgactatagcaatcaaatttgagtggagcatcagttgaatcagctcccaggataatgcaattttttgggagaattgtgaagctcagggttttagaagtaatattcatctgaatcatgctaagatgctggttgtcagggagatgatccatgtaggaccgtgggacaggacccagctaggtggctgccagcgagcctgcaggccagtcttttgagacctcttggttcatcaatacattccaggagagcaccatccctccccagagagacatggcaccaggaaggtacccatg

SEQ ID NO: 9366 - DNA, 12870 bp, artificial
  synthetic oligonucleotide
acaatgaaaaacccatgttttctttcaagatgtaatgaaaagtgaaattacacatatcaccactactcattattttatttttaggttaaagattgcaaataccttaaaatttgagtctgaagggacttttatttctacaaacctcatctattttaccagtaaattaactgatcctggttaaggaactaattgtattaagaaccaaagtcccgacttaatgggccaatggtcagaattttcccaacgttaaatcatttcaattaaaacattcataagaggatgcacggtaattaaatacatctggaaaaataaaaccagttcatggccctgtggtgtatttactaagagtctaccaaaggaaatcagtatgtttccttttttacatgaagggaactttctttttaatgtaaaaactaaaaccaaaaccaaggatactgccagaaccagtgaagtatgcacaaattaacataaattggcaattgaaatgtggagccaacaattgtccaaaacacaaagtacttccttaagaacaggtctctggctcgggcctttgcttcatgagaactgcacccaactccacacctgtttaaaaatgaagcccaccctacccctaaatcagtccaaagtattgtgaaagctgttctggagaaggtccccgtgtgataattccacgtacaaatccaaacgcctagcgttaaattaaaataacgatttcagaaaaagtagttgatgctttcctcaataccacacttgttcgtaactgtaacatctttggtggcaattatcaccaaagtgatcacaggctgagtagcagtcatcctctgagcctcattttgtgtatgagcctcatttaaaacggaggttgaatggtttgactgctcacatgggggacattaagagaagtaggaacctgagttacaggccactcgattctgccctttctagaaggatcttatgctagttcttgcctttttagaaagaaattttcctgttggatttggtgggccttatctcctttcatattttgatcacctagtaaattttttaaaaatgtaaaccagaaaattatttgagcttcctttgaaatgcaaaaaagtgccccctttactcctcaccaaaattttaatccgtacaaaattatcgcccccccacacacaattaatagcaaagataatgtgaaagagggggatgaatgattaggggaagcggaggagcgggcaagcaattcccaagccctcaccattaactcgcaatggttaaacccactgacgtcctcgttaggaatgctcttcacagtctttgtggcttgtggctggagtctgtcactagagaaagataacggagcaggaggagaaaaaccctttcccaagcacagctgtcacacgttttcaggagtgctgcggaatgaggctgatttccacagcactctttacgagttttcctcccaatacagagtccccacttaaagacatgttgctgacggcagcatttcagggtgttaggaagtgacaaaaagaatcctacagccgccttacaccagcctcgggccaggttggagatttcagattttaaccctccggagctgagccttttgccgttgctagtcgttcccccgttgcattggaacccgctcagcacaccgcctccacctgcacccgggccgcattttaatagttggaacaagggacaaagaggagagactcagcctccgtcccatgctgtccagagtctctcctgtcactttcctggtttcaagggtcatggtttcgaaatgagctcccggaagaccccaggcttggggaaccgggtgtttgtttcgcgcgggcttaaggagaacagaagcacggcggggcggggcggggcaggactggactgggagctcgggcgacagggagagcgtcccgggaaacaggcaagaagcgactctctactggccccttaaaataaagcactagcccgggacgcgccgtctgttctctctgcaacccctcccgggtacccagctcttaggctcccgcgagccgcacgtgcgggggtgcagcctggccgcagccggagcggggaccaccccccccacaggatacaacagggaagcgcacctgggcgttccggacacctgcgccgcgcccctcccacctccagcgtcccggcttcgtcgcagaggtggccgaggaggcgccacctgagcgggggaggggcgggaccctcggaagggcgcgccctcccggggcgggggcgcgagaccgtggccgtggcgcgcagccagcgcgctcgcttacccatggctggagactggcgggaggggtgagggctgcggggcgttcgggctccccggggacgggcagagccggtggcacaagtttgcaggtctcgcgggcacgtgcgctgaccgggcttctgcgggctgcgctgcgctgcgcggggctggccgctggctcctagctcccggccggggtgggagcgcggcgcggctccgcctgcactgggggccggccgcgcggagaggggccctgacgtcagcgccgggggctttgtgcgcccggagctagggcccgattgggggcagcgggcgcgcggagtctgcaggcaaagctcgcggcttcctctgggacccccccgggcgagcgccgagggtcgcgggaaccggaaaagccagcgagggggatgggtagagaggggagtgggcttctaggatcgcggaggcggcgatccgcgtcccagatgaaaactattatggcctggggaggttggggggagcggggggctttgaggtcttagccacacccgttgtatagataaagaaactgaggcccgggacactggaccaagggcacttagtacttagcgttgcctcaatccacagtctcagttccttttgttcagatacgagtcgttacttaattcagtggtctcaaccctggctgcagaggagaaatcagctggggagcttctggaaaccggatttcatcatggcctctgcgggtgggacccaggcatccgttctttaaaagctccccaggtgattccaatgtgcatccaaggttgcgaaacattgacataagtaacttgtcggtggctaatgacttagaaagacacaggtagcaccctccaatctagagtggtgccagatttgctggtgtccgttatcacccctcttgattcctggaagtccacccctggaaggctcttggagactttgcaggctagctccagtcaaccatttctcccgctgctcaggcctcgcgcttgagcctttaagtgaattaaatggtttaacagtgtccagggcttaaattccttctgtctccttagagaattttcctgtctccaaaggtattagaagagtcatgggacccttgcagtttttgtaggactaacgctctctgtgacatttctgagcctgatgttcccccctgatattttttgttgtgttcttttattgttctgaaaatacatcatgttatttgaacagagggttacataaacagtgacaatagatagtacactttagggacatttaagccaaaagagaggctttaggactgagaaaggatggaggaggcaaacatttcatctattgaaatttattggattaggaaagattttatcaaggcagagctctagaaagcctaataatattttacatgaaaggacagagatttgtgctaggcggatcagtggctcattttcacaatcccacgggaatagtcatttctaaccaatcttcatgcagtcataaaacaacagggagctcataggtataacttgttgtcctcctgttaagaggaagtaatccatttgcgccattcctgagtgcaagtgtatgtaggaatccaacaataacagaggctgcctgtaaggtagaggaagacaaaggtggactgggtgagagcaatgaggaattcatgctaagtcctagttgagggaagggtgagtttggtcggttcctacatcttgagggtttcctaggagaccctgaaaacaacagaagggaactcaggcatgaccatctgaaatagtactttggcaagacatgaccttaatgagcctctctggaacgaggaactctaaggttttatgtactgagatgaaagtaaactccttggtctactttctgtcattccctagaagtcttacgtttttttttttgtttttttttttttgtcttttttttccccaaagaaagaacagctgtctaaatattggagctagccacaatggatgctgtgataaaaactgagttctaacaattgtgtatacaatcaggggaaagccacattttaacagaaaattttcctcactttgtgagtatcatggattgatttcaacaagcaattgtccctaaaacccttaagaaaaaaaaatagcatttgggaaattagtgaaggctgctatagacgatgcagatgatggctagtaagtatatttcatttcactattattcaaagaaatgctatcttaaaataataaaccatttttctcaagtaactgaaatctttaaaaattaaagcaagattacacctgcaggtgggtgagtcaattggtctagcctttctggaaagccatttggctgtactaccaagagaattaaaaatattcacagcctctgacctaataatccctcttctgggactctctcctaagtaaataacaactgttttgatcaaaattaatgtgaaaggaggtttattgtagagtgagatgtaatagcaaaaaaacaacaaaacaaaacaaaaaaagcaacagttgctcaacagaagggaattagttatataaatgattgtcgacctagttcaggggttcttgactgggagcaatttcgcccccaggagacatttagcagtgtctggagagagttttggttgtcacaactggggatagggtggggggcttactggcatccagtgggtaagggtcagggatgcagctcaatgtcctacagtgcagaggacagctcccctccccacaacaaagaatgatctggccccagatgtcaatagtgccgaggttgagaaaccctgatctgtatgatcggatatcatgtagccttgtttgcaaagaattatgtagaaaaatgctcagagatgttttaaaagccaaataaaaagctgaatatacaacataatcctagtcatgttagtgtatacgtgtgtacgtgtgtgtgtgtctgtgtgtgtgtattgaaaaacacaaagaaaatacactatggtagagactattactttttcaacatttttttctatctggccacacagccagactccatttccccttaactccttaacagttaaatgcggctacctgattgagttgtagccaaagaggtcagaagtgaggtccaccacttccgggcttatccctaaaaccttaaacatattgcttctacatgccttcctcttctcccagcaggaatgagacgttgacccctagggtgcttttggaagccacgggttgaagttgaaattgtcttatcagcctaggtcactgaatgactttgcctccgtcctcctccacacactgacaatttgtaactgacttggacatgtttgtgacccagaaataaactgctattatgtttaagccattatgtattttgggagttatttgttataacagcgacccaaccctaactaatatatccatatattcacttctaccaaaatattaacagggtttgtctctgggatgtgagattaatagaattgttagttttatttgtataccttgttatgttttcccggacttctataatgagcaagaattacttttataatgaggaaaacacaggcataccttactccacagtagatacagtcttctaataatttgattttaaactatcaataaaatcatatttccaactaatttttaaaatttgattgaggggccagatgcagtggctcatgcctgtaatcccaacactttgagaggctgaggcgggaggatcacttgagcctaagagttcaagaacagcctgggcaatgtggtgagaccctgtctctgcaaaagcaaaaaacttagccaggcatggtggtgcactgctgtagtcctagctacttgggaggctgaggtaagaggaacgcttgagcccgggaggcagaggctgcagtgagttatgatggtgtcattgtacttgagcctgggcgacagagcgagaccctgtctctaaaaaacaaaacacacacaaaaaattgaggtttagcagaacttcgatacctcatctaggagtacaaaataattataaaccataaggatgcattttgtctgttccaatcttttttttgtttttgagacgtagtctcgcactgttgcctgggctggagtgtaatggcacagtctcagctcactgcaacctccgcctcctgggttcacgtgattctcctgcctcagcctcccaagtagctgggattacaggcacacaccaccacacctggctaattttttgtatttttagtagagacgggggtttcactacattcgccagactggtctcgaactcttgacctcatgatctgcccacctcagcctcccaaagagctgggattacaggcgtgagtcactgcgcccagcctgttccaatcttttttatccagctttgttgaagtataattgataaattaaaattgtatgtatttaccatgtataacgagatgttttgatatgtgtatacattgtaaaatgataatcacaatcaagttaacatctatcgccatatctagttatttctgtgtgtgtgtgtgtgtgtgtgtgtgtgtgtatgtgtgtcgtgaaaacatttaagacctactctcttaggccaggcgcagtggctcacgccagtaatcccagcactttgggaagccaagcgggggtggatcacctgagtccaagagttcaagaccagcctgggcaacatggcaaaaccctgtctctacaaaaaaaaaaaaaaaaaaaaaattagccaggcatggtggtgtgcgcctataatcctagcacctcaggaggctgaggcatgagaatcactttagctgggaggtggaggttgcagtaagctgagattgcaccagcctgggtgacagagtgagaccctgtccaaaaacaaacaacaacctactctcttagcaattttcaggtatacaatacagtgatattaactatagtcttttgggggacatttactcacttgtgtgcctcactccttcctgtttaataagcactcagggatcttgtctctccagcacaatccctgtatgggcagaaacctggcttgatgtttgattcttacaaatctctttacctcctgcttactctagttcctttctcagcatatcatgcatggtttagatcctttttttttttttttttttttgacggagtcttgctctgtcacccaggctggagtgcagcggcactatctcggctcactgcaacctccgcctctcgggttcacgccattctcctgcctcagcctcctgagtagctggaactacaggtgcctgccaccatgcccagctaattttttgtatttttagtagagacggggtttcaccgtgttagccaggatggtctcaatctcctgacctggtgatccgcccgcctcggcctcccaaagtactgggattacagacttgagctaccgcgcctggcccggtttatatcctttatagacttctctcctgtctctcagcaagacggctactttctcaagccaatgggaggtccatgaactggtcacctatggacaaaatgaaaaaagacagttccatttgtacaactaaatgaaaatgttagcaaaccttgacaatgtaaaagtgtagctgacacaaagtggaacacaggagaatatgaatgaaaaagcagcatcacagatcagtggttgccagaggttagtggggagagagggatgagtaggcagagcacagaggattttcagggcagtgtaaccactctgtatgatactaccgtggtagatccatgtcattatacatttgccaaaaccctcagaatatacaacatcaagagtgaatcgtgatgtaaactatggactttgggtgaagtgatgagtcagtgtagatccattcattgtaacaactgtcccactctgatgcaggatatcgatagtgggggaaggtatgcatggcaaagcagggggtctctgagaactgtccgtacactgctcagttttactgtgaatctaaaactgctctgaaaaacatgaagtgcattataaaaaaagcaacatcgctaatatcctcagcttctcaagtggaagtcaaaagatactgtcaaaatttgattgaaaatagagatttgggaggggggctaatgtaagtaacataaatcttcatcttttatgtcagggagttagtagatactgtttaaagttgctaagtcaagaaagagaggactaagcatattttttaggctagggccattgttctcaaccccactggatctgatgttgcttataaacaaacatttgtaatgccatttctgcgctccttaaatccaaatcaaagaaaaaactcaatataattccttaactatgaaggataactgaaaatagttgcatgcatagtgtctatcttgatgtgtaagtcctcaggtacaatgagagtggaagatgtaataaagtcacctaacaagcaacctacttatagaatccccatgagtgggacaaaggccacctacagagatgtgttgttttgtaattcaaataccaagagtgaccttgccatcaaagtcacaatgttccaaaatagagaacaacttggtaaatttcccagcaaaagaaagtgcaatcttccctcaatttacaagataattgcctccctggaaaaaaatcaccatgtcttaaaaccaccccccaaatatctcacgtttatatgtgagatggagatatactgataattagaagcagatttttcatctatatgaatgtccagaggacagtaagctgggtgagaaatgggaacatgtcttcattgttcaagaccatgttgtgcattgcaggaggcctgtcaccttgtcctgggcccattaaatgccagtagttcccccacaccccctcaccgtgacaactaaaaacacttatgccaaaatccaagcttcctgacttccatgagtctagactgtggaagttacttccagaagaaccaaaacaagaaatagttaaaagagattgtttctgggagggagaccactggctaggagaggagggctgggagactgttgttttttatcataagtccttgtgttctatttaatttttaccatgtatatgcattacatatatatgtacattttttaaaaaataaggcaccttgggaaaactggctagccatatgtagaaagctgaaactggatcacttccttacaccttatacaaaaattaattcaagatggattaaaaacttaaatgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaaaaggcaacctacagaatgggaaaaaatttttgcaatctactcatctgacaaagggctaatatccagaatctacaatgaactcaaacaaatttacaagaaaaaaacaaacaaccccatcaacaagtgggcgaaggatatgaacagacacttctcaaaagaagacatttatgcagcccacagacatatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacgcttttacactgttggtgggactgtaaactagttcaaccattgtggaagacagtgtggcaattcctcaaggatctagaactagaaataccatttgacccagccgtcccattactgggtatatacccaaaggattataaatcatgctgctataaagacgcatgcacatgtatgtttattgaggcactattcacaatagcaaagacttggaaccaactcaaatgtccatcagtgatagactggattaagaaaacgtggcacatatacaccatggaatactatgcagccataaaaaaggatgagttcgtgtcctttgtagggacatggatgaagctggaaaccatcattctgagcaaactatcgcaaggacaaaaaaacaaacaccgcatgttctcactcataggtgggaattgaacaatgaggacacttggacacaggaagtggaacatcacacactggggactgttgtggggtgggggcaggggggagggatagcattaggagatatacctcatgttaaatgacgagttgctgggtgcagcacaccaacatgacacatgtatacatatgtaacaaacctgcacgttgtgcacatgtaccctacaacttaaagtagaataataaaaagaaataaggcacctgagtctattgaatgtttacttctattccttctgggcccctaagaccttatttcccgacatacctcatctgttaaatgggtataatccaatccttacctcgtattattgttgtagagattaaaggagataatatgagtaaagcacttatcatttgggactcaataaatggtagctattgatgcggatcttgttgttgttaatgttatcattattatcccttctttttaccttggggagccagaggggtccctggggtagccagaaagcagctttagggcaaaggcattccaagcttttgcagtaaagaaagggatgaatgttcctggtttgaaattttgtctcatattattttaggcagggggtgccctcccttggctctgcatctgctctggaaggtggaaagaaattgctgatttccattcttctattatgtagtggtttgtttgtttgtctacttattggtgaggagcggaggtcaggaggtcttgagtagtaagtgagtagaaagtagcccaaagtagcaagaagcaacaggcaattaacaaagataactttcttatgctgtgggactgtccatcatttaattagaaaaaaaaaatactttgagtttaaatacatacctcttaagaccacaaatgcccccgaacactaaagatcactcacaccttgagtgtgaatttagatggctttggaaatgcctacttgagatcagccttcctgagagtaggcaactttaatggaagaaggaaagacggaaagtacaagggaaattatagagctctaggaagcctgggcagcccgcgcccggcatggggacagccaggaagacctacaaggaggagctgccagaccttggagaggaagctgacataaagcacccgatcaacttccttctcctacattttactatgttcaacttggggacggaagaggagaaaatgcaatttctgactacaagatgtttaaggggctaattgtcctctgggatgggagaaaacaggacctctgtaactcttctgggggctcttccagtcatctgcaggtgacagagtgaggtgtcctggctctctgtgcccttggctttctcctgaggatcttcctgagcatcaggtgaggaccctagattccctctcacacttttctggttatcttaaggtgtctgaatctttcctcgtgctcctttaatgaaggaactgggtcttggagatattagattgtgtgtcccagatcacacactgagtacatggcacatttaggttttatttatttagagacagggttttgctctgttgcccaggctgaagtccagtggcctgatcatagctcactgcagcctcaacctcctaggctcaagccatcctcccacctcagcctcccaagtagctgggactgcaggtacaaagccaccatgcccaacaaatctaaaaaaaaaaaaaaaaaaaagttttttgtagagatgggggtcttgctatgttgcccaggctggtcttgaaatggtaggttcaagtgatcttcctgccctggcctcccaaagtgctgggattacaggcatgagccaccaccctcagcctagatttggatttgggctcacctctatccaaatctaaactccgtctactccaccatgttactctctgtagaagatgtttccagattgtaggattgctggtctgggctacaaggaacaggtggaagccctcagccagggttacattctagggcccactttcagaatctaggtccagtttggctgcaatttagagaacagggaaaaggcctacatgctgtgatgtatcttatggaattgcaggccagaagtgaggagaatgaaggcaaaaaagaaaatagcagcatcccaagggcctctggagttcacagctggttaaaagcagatcctgcctttaaaacacaggtcatttcatgatgtctcctgcgagtcagagcaattggcaagtgattttcctttggtttttactgagcatttcaatcccgaagtctgggctatgtctacctctaaagcttgtgtctttcatgggatgttctatagttttgcactgtggctatgttacccacatatgtgaatctagaacagagttcacagcagtgcatcaggaactcgcaatgaatgccaaaaattatagctaatctgacagtgtgtccttgtgtttacagatgatactgaaaattgaatcatgcaaagagctcaataggtattgaaataccccttcacctgtattagctgacaatgatttctcttacttctcctacacttcccaattgcctagtaataatgaatttggtaccctgttggaaaaaagga

SEQ ID NO: 9367 - DNA, 832 bp, artificial
  synthetic oligonucleotide
tcagatatttgaaaaaataaacaatgtgacaatagcaaatgctggtaaagatacaaagaagctggaatgttcattcactcctggtgagagtataaattgataccaccacttgagaagcagtggtaacaccatacgatttaaagctagttcagtgtggtgacaaagcattcattttgctgactgcatcatttactctggttaagaagatgacaaagttcctcactgaaggaacataggcaaagtattattgtctaagtccaaacaaacgagaagaaaagtcaactggcaaaccacaatttcctatgtagttccattttcaggatgagaaccaaaaatcatcccaggcctttgggcctttgtccacacctctactccatttggaatatccactagccaaagattcactaactactgctaattcaaacaattcctaaaatttcaccttctacaggaaactaattgggaggaggcaggcctcaacatctattacatccttaagtcctgaagttagcaagcattcacgttgatcaaatcctgaataggtatgcaacacttacagctttgtcttcattcacaactcctcaaaatgtactttccatttctgaaggggataatggggacactttatttttgtaatctctccagctgtatacatgttttcatgtatctatctcatctttcatcaaggattttcaaagtccttctcacagctgctgtgtcaatgctttccacttaaaatagagggtaggaaccaatgatatgtgtacttcctagtacggttctacacacgaaagcatttaataaatgcttttaaccataatgatttagaagc

SEQ ID NO: 9368 - DNA, 1327 bp, artificial
  synthetic oligonucleotide
ggtctaaagccagagtcctttgaagactggtcagaatgagactatagctacatctgcaaagtttcagaagaaaaagaggccaggcgcaggtgctcaagcctgtaatcccagcactttgggaggcctaggcaggtggaccacttgagttcaggagttcgagaccagcccggccaacatggtgaaaccccatctctactaaaaatacaaaactagccaggcgtggtggcacgcacctataatcccagctagctactcgggaggctgaggcaggagaatcacttgaactcaggaggcggaggttgcagtgagccaagactgggccactgcactccagcctaggcaacagagtaagactctgtctcaaaaaaaaaaaaaaaaaaaaaagaaagaaagaaagaaaaaaaaagaaagaaaaataggcaatttatttgtcctacttcagtatcaggctggaaacggccctggtaggggtggtggggttgtatttagatcactaccttcttctattagaaccacaggaaaatgctatatttgtataccacaaagggtcaaatattgtctatttcataatctgaacctaacatcttcaccaaggattgggaaagccagggaaacacgatacgtaaaccagccattgtactattcattagcagctcttagaagaaaataaaaagattaaacctattgcttgaaattaatgggtaaggccgggtgcagtggctcacgcctgtaatcccagcactttgggaggctgaggagggcagatcacaaggtcaggagatagagaccatcctggctaacacggtgaaactccgtctctactaaaaatacaaaaaattagccgggtgtggtggcgggcgcctgcagtcccagctactcgggaggctgaggcaggagaatggtgtgaaccccggaggcagagcttgcagtgagccgagatcgcgccactatactccagcctgggcgatagagtgagattccgcctcaaaaaaaaaaaaaagaaattaatgggtaaatgaaaaaaacagttcacttcaatgttttatgctgtcttcttttgttacatgaatatttgagagtttgctagaaagaggcttaaatagaaacttccaagtactattttccaaagctaattacaattcagttttatatcatatatgctatcatcatttatgtttcattatcataaagaatgccttgtaagagtttaatgaatatcaactgacttacacaagtaggcccacatcagcaatagtaatgaatgaaaaccagtactacgtctgtctgcatcaggaaaagatttgtcctgaaagatgcccttcagaaa

SEQ ID NO: 9369 - DNA, 1098 bp, artificial
  synthetic oligonucleotide
tctcatgagacccaggtctctgctcctcagtccagcactcttctattctgccacaacagctaccacctgaaggagctgcccaagagccagctgaaaatccctaaggaaaccaggagaagaaccacaggcttctgtctcctacccggtcagggctcatgacccacactcacaaccaaacttcaattcaatcacagagaagcccatctctctttattcccaccaccttggcaattccaatgacagttactggtgcccaccaaagcacatgacctgcagcaccacagacaacaacaggaggcccacctgacccagtctcataaagaagttactaaagatcagtctccctcaagagggcgggagactcaacgaaagaggacccagttggatattaatgggtctatccatagtttgattccaccagatggtcctagaactatctaggaatctctggggctggaccctgggtcctagaaatgaccacaacctaacatgggtgtcagaatcagagcttcactcgaggaggacctcattaagggctagctgacttagacagactcactcccatactttgttaaggggtcttctcctggtccaccacagcccactgtgattctgcaaggtgagagcaccttgacaccaggcttagacatctccttccatctgtctcccacgcagggtctcaaggcatctttgggttcacaggaccacctcaaaatctcgatttataccaggctaacccccagcgcccaaccatcaaccagcccaggcaaatactacctcacaggtactgagcatttgccatgcaccaggcaccactccaggcacttttcttagagtcagtatattatttactcttgatgtcatcctgaaaggtaagtataatccccaatttaccaatgaggaaattgaagctcagggagaataagtataggcacttgcccaaagcacatagttagcagaataaacacatcagcattctgcccctaagctcacgttcattatcattttaccacgcagactcttggatcttctccaatgcagggccagtctccaggcatggtcaggacagcataagttcgtcatcatgaacaccgtcat

SEQ ID NO: 9370 - DNA, 648 bp, artificial
  synthetic oligonucleotide
aagtctcccaggttgtggggtgataaaaaattaaaaggttgaaaaaaatggatacaaaaatgtagcctgggtaaatggatggattgtcagcagcaacccacaggaacccactagtagtctatttgtgtcagaagacagaaacacgcaagtatggaatgggaaagacgatgaacaacaaggaccaagaacagtctggagcccatgttgctgtgatcatacctccagatgggctgctcctcagtggtgactcgcagcccagtcacttaggagctgtacggacattgagcaactttcactctctccatgccaaaattccctaccacccgaacaggttgacatgagaatgaaatgcagtcattattggaaggcatccaacaggacctggcataaagctagttttcatgaaatgttagctcttttcccattaatcatcctctccagttgtaagattttaaaatgtcattaattttgttccttgagcaaatctacgccttcttgtgtggattctgaataaatcataagtagaacttcattatatgataaagtatttgtaaatagatgagactgtcttatcctgaaaataactcatttaatagagtgaagttagatggaaggtttagtccaaaagcttcacacagtcacttgttc

SEQ ID NO: 9371 - DNA, 408 bp, artificial
  synthetic oligonucleotide
tttgtttttttgttttttttttaaaggaaagcttctatttcttcctgtgtacacaaggcatacatcaggagacagacagctgatctactgacaacatgcttcctaattattacatcccatggggcacttggattctctcattaagagtggcacaatgagcattccctgtgagggcccccaattaactcatctacccagcatgttccagccaacatgaacaagggccagccttccagactcctctttgttagctgtttaaccgccgttattggaatccctgtcatgtttctggagcagttccttctcggttcagcagaaaccaccggggctgggttattctctcactcaaagagtctgcaactcaaccacaaagctggtggaacccggggtgctctgctgaggatttgc

SEQ ID NO: 9372 - DNA, 1937 bp, artificial
  synthetic oligonucleotide
tttgtggctatcattttatcctatgtgtaccttaatgatgatgggtgagcaaattgggaaactacaaagtgtcttgtgtgggctttgattttgtgtagccagcatatgaacttgttcatctaaatgcagattagataagccaccctccagatcaacaattatggtgggtcacacaacaatcacaacccctcttgctgtagatcaggaaaaacaaatcccctggcttgtattcttattcaagcatgtaccatacatgtcacactagcttctggtagtgtgatatttttgaattatttaacaagcagctagtgtttatacatttaggtaatttttaaagttccttcacaaattatcttttgcttctaattttgtctctaaaatcacaactaatgacttttcatatacgggttgtcagggatgtactagcaacctgtagatctgttattaaataagatttaattgacataaaataatagcagtccataagactaagtgataagatacacagttgtgtagtaatgattttatattggttatatgacctttgcttcctttcagagagaaatttaaaaaagggatttttttgcaaagaccaaaacggttttatctgccatggttgaataccacattaataaaaattaaaagtatgtactaagtaaaatcatcattttaggataaaatcgtgataggcttccttgggacaatgctattacattatcataccccgacaacatgcaatcaacttagtctctagtcatcatggaaaaaactttgatctcacttcttcatcttgataaatattcccaagagcttctcttatagctatttggtcattgatgaagattttttttttttaaagacacacaagaaaatacaggctgggtttttggtggggaggtgtagatttggtaagaggattgaactaaacaaacgattttaaaattaaggtgctatgtacttaatgccactgaatcgtatacttaaaatggtaaattttatgttatgtgtattgtgtgatacctaaaaaaattaatttaaaaagtaaaattgctctgtttaggataaaatattattgtgtaccaaagaaattttatataaaaacaagcagtctttaccccagcatactgtgaagctgaagtacatgtaattgccgtttttgtaggtttaaaatggttgactatcagcaatttcatatggttcagcctgtatctttataaataaaacgaagttttgtccccgtactggcgaattactctttagtgactatcagtggacgcaagggctgtgagaaataaccttagcatgatggctttttatattagagccactgcggttacagaatatgtttttgggcatttatgacagtctatgactttgagtgagggaaaattacaatgcagtgagatccattaacctaacagtggctgagccgattctatgggacatcaaacttgaaatcagtcattatttagaaaaaagagattaattttagttcctttctgccattttcttactgcaaaaacactttattctccaaaaaaccattctgtatatgaaaattgtggtacgttctaagattctctttaagaaataggacctttatcaattttcttccccccagtctccaagtcataattagcagaagatcccccgccctgcctttccatcagcactgggtgacagagctgatgtcccctctctgaagctccaactgtaaatgattattacatgtcgtagtcagggcctgatacaagaaagagcaatcatattagaataagaaaattagagaatgcccaaatcactacagcattagcggaaccaaagcagaattaacatgcatgcccctccagttcctcctcagcattagcagaaaactacacattccacgttcctggaatataacatgcaggacacaagacctaagttacgattaatta

SEQ ID NO: 9373 - DNA, 753 bp, artificial
  synthetic oligonucleotide
gagaatggatggctgatgtcacctcatgctcaccctatttagccagcgctgcacaggcacacacagaaccaacacctgatagccataggacagatgaaggaatgcataacccaagacagaactaaatccaacgtcagatttcattttaattaacctgacaacacaatttagattttaaaggaaaaggttttattaatcatggattttatgactttgtaattcaatgggtaacttacattgtaccttgggattgccctttctggagctgtaccatgctacatttactcctgaaaaagttagcaagcatttgggagaaatgttatggattgatgcaaaatcacagaaatactttaagcctcttactgtgtttatccgacctaccaccagccctttatgtctgcattttatgtagtttgaactatggttgtacactggcaaaatcactgagttttagctaactgagctgggcattacaacttgtgttggttttgggaacgtgggaggttggatgttcatactgcttcaccttttgccccttctaggtccccaaatcagctgtcgcacacctcacccagatccagcacctagcggttctgaatggccaatgttcctcacgagcaaggaaaatggaaaccggacccactgaacctacctgatgggaatcgggtacatggttatccaatcctactttcacagctttgatttctctttctcaaaggcaatgactgaggtgagagggtggtgcagagcagc

SEQ ID NO: 9374 - DNA, 964 bp, artificial
  synthetic oligonucleotide
aaaccatgaaaaggaccctggaaccgccatgacctttccaatggggaataaggaagttcctggagaagggcagtctctgctacagtaactgcatgagtgggagaggcattttcctttggcaaaaatttcctggtcagcctgtatcaaaacctctttttcccccatggaaaaaggctgacaactctgcaaaaaaattaataaaaaaaaaaagaaaaaaaaaagagccatacagaattccctattttttgcctcataccatctggttggggttggagatctaagtatagaatggcaacggcattgatttaggacccaacaaaatctgtaagtgtctggaaaggcgatggcatggctagagtgggtcccttcactctgtggcctgcgctgtaggctttacactatcacacataaggtctctgcagacagctccagacattaacagtccccgtggaggcatcttttttccaattatttccatcaatgcacacaaaaagttaaaactatgtgtaggtggagattgtttcaggatctgggaagataattctttaaatcaaattcagtgattttgtttctccccctcaggcaagaacctgttagttcatggaattctcgcttgcagtagtatcaccagcaacctgatactattagacttccacaatctttcatcatatcattatggaattccaaaaaacttgaaaagtaatttttttttctcccctaactcatctggcagcaaaacctgttctgatctcctcttccttggtgccaaaatctcacctgaatggacaaggagttgtttatagtcttgggctctccagaaagattaatgagttagatctgcagagacactcagtggtggtatcatgcagtacatgatgtatgcactatgttatcttttggaaacccaaattctttggaattctgaaagaaatcagtttcagaaaaacagaaaatggagcctcgt

SEQ ID NO: 9375 - DNA, 2593 bp, artificial
  synthetic oligonucleotide
ttcagtcttggtaaacatttcttctttgcacatagttggaactcagtgagtcccctgtcctgcttgagccctccttataatctccccaacctgtgttcatttctttggaggtcatttgtgaacagataagaaagaataaaattccctaaggactgaagagtctccaacatgactccatgaccattccataaaaattcattcatgtctttttcagtctggtgaagaagtttcttataatcataagacacactaacactggaactttgggattcaagggaagaaaaagaaacggtagaaggaaatggagaaaggggaagacatgtgaaggaaataagtagattgctgctgagcttgcacagctacaagaatctatgtgtgggagtcactgcgactccattgagaatgtttccagaaagaaaggcagagatctgctgctaaacccctggaccttcctctcttctgcaatggaggatgccctgggatctgctcttctgcaatggaggatgccctgggatctgctcttctgctggaagagttaatgttaaaatactgctcctgtaggcttagagttggggtcagtcctcaacagggctcctaccattccagggatggtcacttcctgggagaaagctggaggcatctgttacttgggaacaacacaattctgttgagacaatcggcagcatcacctatcaccatgtcacagctccccatgtccacagctaccatgtgtggagtgtcctatgtgtgcaccttaccattcccaagtaacattccaccctggggcctaaacagctaccatattctaggccctttctttttccttctctcatgaacctttttctaactacataaagtgagctttaagtaaaagcattcatcttctgctaggaaagcacactgtagtctttctgaaaaacatcatgaggtggttgcatctcagatactttttttttaaacaaagtatcactctgtcacccaggctggagtgcagtgttgccatctcggctcaccagctcaccgcaacatccacctcctgggttcaactggttctcctgcctcagcctcccaagtagctaggattacaggcacgcaccaccacgcccagctaaatttttttttgtatttttagtagaggtggcgtttcaccatgttggccaggctggtcttgaactcctgacttcaggtgatctgcctgcctcagcctcccaaattgctgggatgacaggcatgagccaccacgccaggccttagatgcatttttaaagggaaccggatacttacacctcgctcagcaaggcatggtcactggcgttggtggagaagtgttgctcaagaatcgccacggtgcctgcgagagccacatgcccacagccgcagaataaggccaccccggagaagcagaggatggtggccaccagggaggcgtaggggactcctcccagacacttgatgcagcattcaaagcagcctgaacccaaaggagagaaaatatagccgttacgggcaagaacacctctggtcttcaagaataccccatattcacagagaaggcttacaattttccatctcccctctcaggctctatggttaatattaatacttcgacatcccaagggccagtgtggtagttaccgtgatctcacattctgcggtgaggaccctgaggctccaaaagggaatgtaacttaatttgctcagaatctggaagggtagtgaatggcagagcagtcaattgacaaagagttataaggtagttacagttctagagcttcctgatcgactgagtggtggggggagccccgctcaagtgccaacaagaagcactcattccactaacacagtcaaaagagaggacagcagtgaagctgcagctctgtgaagaaaagcaacagtcaggtcgtctccagcctcacagttctggggtttcaatacgtctgctgctgtggcaaccaacggctttccccaagccctggacctccggggcaactgggagaatctgatacagcaattatgccgtcgccaggttcaaacaaatagcaaggtgattgttttggaaaggtcacaggtattttggtccataattcagtgaagaacaaagtcaccaagagccactcaagtgggtctactcaagtttcattcaagttgacatcagaaattatctcaaatttttaataaaaatgcttccccccagcccagtcagcccaagcaattcattcacagtcctcctcctccccggcttccacctgcccccttccccgacacacacgttcagagtcagaacccagaactggtgggtgatatttaagtacttgaaggagaaaaaagaacagaagaaaaaaacaaaaccaaaatgaacatccatgaagtggaatgaaggagagacagccgtaagtcactcttaatcttgaaaagacgagacttgtattcatttttaaaataaacttttacttgagatgtccataaagacctgcctcaggggcagagccaggtgacgttttcagtttggagacatttacgtttcagtaaaggcagcactggcctcaggataatgtcagtacctctcctaacctcctgtctctgtttatattat

SEQ ID NO: 9376 - DNA, 1563 bp, artificial
  synthetic oligonucleotide
ctttaaaggaaaaccaattgaaaacaaatatcagtgttctcagagcagacatagtgaatggtatatactgtagtagaaatatattttaatagctacccaaaatgtctgttaaacaatattttaagtacactttaattacggttttaaggacagtaaaaatctatttacatttttaaacaatgaatactttttaaaaaattgtaattgaatgacccaggaactcagtcatgtagtcattggttcatcagatatttcagtgtcatctgtaaggcattaaacatttaggcatatcatctttgatgtgaagtacttagaagttaattagatgataaagatattttatccttttgaccttgatatgtttatagtaatttatttaacagtgtaagaaagagcttgaaatttgctttattagcatagttataatcttatttaatctgaaggatgtttcttaatttcatattcagaaacatatcctaatttatcatttaaacactgatataaaaatatgtctacttagtaacctattttttcttaaggtatttactatgcaggatctattacaactcattaaaatcaaccctacttccagtctctacaaatcactggtaagatggcttagtttctgtaatctactttggtttgttaattataactgaatagctgaataaaagtgaaatattttcttttaacaggtttcaggatctgataaagaaaatcaaaaaggtaggagccgtcatctttgtagagaacagcaacagttttctatgtactttttcctctaaaagaatgaagcaaatttttagggagaagagtaaaatttaatttgatttaaattatttgatttctgcaggtcatttcccctatatttccatttttgtaataacttttagatattcaattaaaaaaactgtagacagtatcaaaggccctacagacaggctgaaagatactgtttgtaaaaatacccactgttgggaatatttctgcaaaaaaaaaaaaaaaaaactaataacttttaggccaagtgtctttgtatactaggtatccctctcaagtataattggtagggtattagatgtattaatatttccttaaagaatgagagttgtgttcagtaatgtgttatatatcttttgttcttaaatgtttatacaggccgggcgtggtggctcatgcctgtaatcccagcactttgggaggctgaggcgggtggatcacctgaggtcgggagttcgagatcagcctgaccaacctggagaaaccccgtttctactaaaaatacaaaaaaattagctaggcgtagtggcgcatgcttgtaatcacagctactcaggaggctgaggcaggagaatcgcttgaacccggaaggcagaggttgcggtgagctgagatcacgccattgcactcctgcctgggcaacaagagcaaaactccgtctcaaaaaaaaaaaaaatgtttatatagacctaataaattgccttaattttggccttgataatagccattcatagagtccataactactgtgggtttcaggccattggttagacttgatgatgg

SEQ ID NO: 9377 - DNA, 2828 bp, artificial
  synthetic oligonucleotide
ccaaaccgttccataggccaagcccagggctgctcatttgaagtcactgggaaactagaaactaaggggtgggtggaacaccaacagtgccagagtgggaggatgctcagtgaacttggaagtctcttaagttgtagacaaatgcaagataaaactcatggactccagttccaaagacatccatttttgtagcatgcctctttacaacctctatagaagagcttctagaaaaactgccctgtgctcgcgagagcagtgatttcagttgttccataaacctggggtcatgagactaaactggtatggcatgggacatgtctattacaatgaggaggggcagtaggaatactactgataggtctttaatgtgacatttttctattaatattataagcaattctccctcccctagaagttatgctagtttttggagaacattttatctaattatattcatgtattcaactgtgggaccaaaggtggaggtgggagtaagggggtcttcaggaacattttttttttttaaacagtggacaagtgattctacttaacaacatttacaacatatcaacatctttttagaacactgttttcatcattccactcaaaagcctttgatgcatctcagctacaggatcatgtactagtattcaagattcccacattgctccacgtgtcttttctcagccctattgttccacctctgctagcgttgactcgtttacttattttttctcccaaattcactttgactatatcgagttcagagctactatcatttctctcttcatgcctggaatgttctcctttattctgtctgcaaccactacccatcctttaaaatccaactaagcctctcctccttttccattgtttccaacaaaaacttacaggttctccacctcctatgaagtcctgtcactcttactgcctcttaaatactttaagtttttcacagccagagatcaaaactcatcgtactcatcttcaatgctgtacacaaagctgacatccaattctgtcctcacaggacttagataccatataaggcttatattcccagcacacaactctggagtcaggctagattcctcactgctcccaagaaggtcgtggcttttttttttcttttaatgattcctttgctcatttttccccttcctgtgatgttctcctttttgctcaccacccgaatcctacccatcaaggccccgataaagacacactttttccacagagatgatctggatcacttccatcttcaaccacctcccctttaaactctttatccagtctacaatgtatcttagttcttgttcaattctctggctgtaacattttcattatcgcttctgagaggtttggttcctttcctttctaattacatttaagcatcatgaggactggctcacctttacctcacagcacacaatggttggtactctaaaacgtttagctctgtggatctcaacccggagcgatcttgcttccaagaggacatctggcaatatctggagacatctttggttgtcacacttgggggagaaggtgatactgacaaaatagagagcaaggatacagctaaacctacaatgcacaggacagcctcccaaaacaaagaatcttccggctccaaaaggcaacagtgcagccgttaagaaaccctgggttagctgaatgacccagtgaaccgcgaaaccacagcccccgagagggcggacgtctgcaggtggaagggctgcgcggatgagccagcggagggctggcaggtccggcccggccaccccggggaggggtggaggtacaggaccaacatccgcgtcacgcaggggctacgaagtcctccagggactcaaaacacccgccccccgccgcacttgctccattccctacctgcagtgggaggccgacaacggaaacgcaatgtcagtttccgcggaagagacccgcgccccgaacctgtagccagaacgccgaagcagttctcgcgataccctgggatgtgctctcgcgatacgtaggcggagcttccggccggtgctgggcaaccaagctcatgcgccgtagctcttcagctcgggaaggctatatttagcaggtttccggaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcaggtagacacacctgccccttctcgggcggaaataaagtcttgttttgtgttcgttaaactttcgccgctaggcctcttatggcttccccggaggccactggtctgttttcagacgttcacgttccctctgccccgcaggtaacctataaccattttgtcttttagtccaacatgtttaccgtggctgatgtgttgagtcaagatgaactgcgcaaaaagctataccagacgtttaaggatcggggtatactggatacactcaaggtatcggatttaggcgtatctgtgtcagcttttacaagtgtaacctgtaacaggtagttcaaattcaatcaaggtttaggttttaataatcgtatgatacatagattgtattg

SEQ ID NO: 9378 - DNA, 1346 bp, artificial
  synthetic oligonucleotide
ttaactcccctccagtggggtgccctacaaatgtcaagtatctatgtttccctcagaaatttaaaatagcccaccctgcccttgtgaatttgccgtgatgctttggggcacctcagcatgcagtttgggaacctcaggattagaagttggtattattggctctagtttatggactacaaggtatagtggtgaggagaaaaggcatcaaagtccgtttttaattctccatccccccttccagtatctgtaagcttttcccttgggcccctcatttcccccagagctttgcagttttgggatgctacccttttagttgctaagctgaggggagggacagacaggaaagagactgcagttcaggtttcctgtgcaaatcgtccctccagctccactttcctttgtgctttctctccattttctgctgggtgcaattccttaggaagtgggtctgctagggtagcacagggatgtgggtcatggaatctacagcctttcagggacccctcgagcctccggacccggcctgtctggagaagtctcgagaagtgcccgtgtgctgttcagttcttttccagttctctggtgggaatcagctttctcattgttggctgctgctttccgcattaggtttcattgtctcttcactctgtcactcccggaccatttgctttccactttctaaattttgttgctgtcttgcatctacagttgttctttcttggtgtcctttttggatttgtaccttacgtagaccttttctgtcactgggtgggagtgaagataacacatacttgacctgccctatttagttagacctggggaagtttgtggacttctgtttattgatctataaaacatggatgatagtgtccaacttgcaggtaattttaaggtgctatatgccaggtacctagtagatattcagttaatagtggctgctaatataattacagccatagcatttattatttgagcaagcaaggcaatagcaataggtagtgcgaaaagtggacatatttcatgtgtggctgaatgaagtgcgtaagagaaaagaaagagattttcgaaatggagaaaataattagctcagttttagatatgttgaatttgaactaccatcagggtaccagatgaacatactatacaaggggttgcaaattcttgtctggctcagacatgcggatgtagactttaggaatcactggtttttatagcccagggagataccatctggaaacaggtaagggtttcagtctcgtgaaatagcttcatgaagagcttgtcaggaaagggagctgtctatgttgaagaaagctaaggggccaaggaggagagaaagcagaacc

SEQ ID NO: 9379 - DNA, 860 bp, artificial
  synthetic oligonucleotide
ttttgtggttgttgacttagttgtctgttagcatgcattacagactgtacttggctatatgttagtaattctagaagtgactctttgaaaataattttccccaaatcatatacataaacactatttgtaactcacgagttttttaaagtttatatgcatttatttttgttataattcagtggcttttagtatattcacaaagttgtgcgattatcatcattatctaattccagaatgttttcattaccccaagaaggaatccagtaccagttaatagccactctctattccaccctcttcccagcccccagccccccaaccgccacctactttctgtctctatggatctgcttatcctggacatttcacgcaaatgggaccatacaatatgtaggtttttgtgtctggcttctttcacatcatttcttttttcttaactcaagaagtaaaccatattttactaaccaaataaactatactgacctttacttaaagtacatctttagctgaatttgcataaataatttgacatttctacctgtcacaattatactccttccaacttttgtgtcaaaaattatttttgattaaccacatgcaaagcttgacattttgaaattcagatactcactgttatctacagatgaaggtcacaagatttttttttctttaaaaaaaaggaagcaaggatattttaccctagttttgtaacttatttggcaaaaaagaatttaatgaaatttcatcactagagccattgtgtttagtaaggacaaaatttaggaatgcttagaagttggatcaatttttttctcccctgtatgtctcctcccaaacatacatatcctgtggtataaaat

SEQ ID NO: 9380 - DNA, 1596 bp, artificial
  synthetic oligonucleotide
gagtattggattggatactctgtttccctgaacctttccccaaattaccttggggtaaggcatcagcaaaggaggctgtcacattcgttcaaccatcactgtgcttttactggccctttgcaggcaaagaatgagaatatgcacagatgagaagtccaggatgcacaagaccactcaattaacatttactactttcatatcaactgatgcatgctaggatgctaaaaacactttttgaattaattactgcgttaaatagattcacatttatgtctacagttatgtgaacatctagctgagcactgtcttgactgtcctgagtagaagcagaaaagataagttgtaaagtacatcaacaaactttgctgctaaaaaacgaaagtgcagtttctttctctcgggcccggggcggggccatggctcctcctctaggaagccgcgcgagcgcagtcccacggcagccatttccctagcgcgcatgcactgggtcccaggaccacgtgcgccggcctgtgggcttggattggctgagccttgacgttgtcccagtcccggtgatcggaagttctccgtgggcactgggcggctgaaggctccggaactgcgcctgcgcttttcggtgagtcatgcttcaggtttgccagggcctgtgtcccgcaaaaaggcgagcccttattcccagcggaagcccaccccggctcgcggcagctttccggtgcgccctgggcggcgtagatccgaaggtgctcgcacccccgccccttcctctccgactgtcgaggtcgccagagtgggctgaaccctcgggactgtcgctgtttgtgtgctgggtgccgggccgtcatcccaagatgattagcggcaggctttgcatgttgctcgaccccacccaccggaactcgaacccgggctagaccgggcagttgggctggtcccttcctctcgctgcacctttactaggggtcaccattaagggaaatggtcctagtgcagtgctgagtggctgttcagtaaccgctacaccgctgccaacatttggcatcgtttctctccatagagggcggggctccctgtgaagctggggagctgttaagtgggttagggctagaaagttacagtttctctttaggctttaaagagatctaaagatctgaacagatctaggttatttttgacttgttacaaacttctggaaacattgtttccagacctttcctctcgttcttctcagggtttaggccatttttgtgcagatgtgtgcaccttgcttactataatattagctaatctttataagtttttatatggatccaataccatatttcgtgcctacttttcctggcactgtatacactttttggtataggtatgcacctaagcaagcattatccatattagcatcagttctagaaccgtggcgtcccaataatgatagccattagttacataaggcttgatcacttgaaatgtggctagtccgaattgagatgtgctgtaagtgtaagacacagtgaattttcgagaattagcatgaaaaagaatgtaaaatatctcaatttgtttatattaatcacatgttgaaatgactattctgga

SEQ ID NO: 9381 - DNA, 1117 bp, artificial
  synthetic oligonucleotide
ggctgaaatggcaaagcgcttctcttgggcactgtaaatcagaacggtatacttctggccaaatgtgtctcccactgaagactaagaagagaacatggctgtcctttatattgtcactgttgataaataggccctcctggcagcatgccaggtcatatcatgaaaggacagctgtgggtggtgtgtatagtgtcagtccatgagaatgagtcatgaggccacgcggtgcaagaacgaaagataaaggaagcagcaccgaccaacgcttcaatgtttaatgcttatgtctcactatgccgatgaactgctgttacaaaacgacttccctttaaaacaaagactcaaaaaccaaaatgaagtgaggcatttcatggggcagtccacatgtcaggatcacctccagactgtactactcctggttacaagccactctggcagaacaaaaccccagatgacaggcctcagtttggatttcttcatagcaatggaaacagcaactgcgcaggcaggcagaggtctttgagtagagttggtgtccccttgttccatttcattttgtaagtgttctatatttttctgattaaagagaattttgaagaatccctagtaacaaaatagtaaagatgttgcactgcctctgaattttcctcttatgatatgcaccaatgtattagtacattctcacaccactgtgaagaaatacctgagactgggtaatttaataagcaaataggtttaattgactcacagttctgcagggctggggaggcctcaggaaacttacaatcatggcggaaggggaagcaaacatatccttcttcacatggtgaaagcaaggagaagtacagagcaaaaggggaaacaccccttataaagccatcagatctcatgagaactcactattacaagaacggcatggtggtaactgctcccatgaatcaattacctcccaccaggtccctcccacaacacataggcattataggaactacaattcaagatgagatttgggtggggacacagccaaaccatatcaaccaagaggtgactgaagccagactttctggtccttcatcattcctccactaaatgttgccataaatctatggtagaataa

SEQ ID NO: 9382 - DNA, 421 bp, artificial
  synthetic oligonucleotide
tccctttccttaccattcctttcttccccagcattaaaacatataaagccccaaaatcagagccagaggctagccttagttataaataaaaaatatctcattcttcacccccgccctttcccagtggtatttatctacatcagaggtcagccaacttttttctataaagggctagatagtacatattttaagctttgtaggccataaactactttcacaactattcaactccgtcattgtagctcagatgcagtcattgatgttatgtgaatgaatgggcatagtgtgtttcaataaaactttataaaacagacagtgggccaggatctacataaaagtaaccacaggcactggttcaaaacttaaaactagctgaatgaactcttatatttctctgacacatctaaacaaggcagtcatt

SEQ ID NO: 9383 - DNA, 291 bp, artificial
  synthetic oligonucleotide
aagactggggtctaatattccccatctggaagtttcctgattcagttcacctttccctgttttctaaatgtccctgcagatgtgaatgagtgtggaatgaaaccccggccatgccaacacagatgtgtgaatacacacggaagctacaagtgcttttgcctcagtggccacatgctcatgccagatgctacgtgtgtgagtaagtttcaacagccaggctgatctcagtcaatgtttaaggcttggcttttgccatttgatgcttggggaaaagctgacttcagtgatttt

SEQ ID NO: 9384 - DNA, 2474 bp, artificial
  synthetic oligonucleotide
tgagcccacctgctataaaatgggcatagaaagcaaacattccaatgcttaattcctagtaggtattgcataagagtaaatgaatggatggatagatacatacctgcaaaaagaatgcataaggtgagcatcagcccaagatacagaaagtggactggccagaatcttaggtaataagcccagtggctgccaagaggcaaagaaggcaggctggaaccaggctgtgaggagcccagtacactgagccaaggagtttggacttggttctgacaacaatagcgagcaaacaggccattgcaggctctgtgttctttaaagttaacacgatcgtgactaattcatgcacagaattatgacaaaattgcacagaattattaaggtaatgagctatagtttagtttaattggcagcatttttcttttctaatgtacatagtaatagaatgcttataatctatgatatctcagatttaatgaatttaagtacaaaattaaaactcaaaataccaaagcaacaaacgtcaacaaagatcatcaccttgctcttcagtacgttctgcttggtttctggatatcacatttattagttatctattgctatgcaacagaatacttcaaaatttagtggcttacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattagacccagccatcccattactgggtatatacccaaaggattataaatcatgctgctataaagacacatgcacacgtatgtttattgcagcactattcacaatagcaaagacttggaagcaagccaaatgtccaacaatgatagactggattaagaaaatgtggcacatatacaccatggaatactatgcagccataaaaaatgatgagttcatatcctttgtagggacgtggatgaagctggaaaccatcattctcagcaaactatcgcaaggacaaaaaaccaaacaccgcatattctcactcataggtgggaattgaacaatgagaacacttggacacaggaaggggaacatcacacaccggggcctgtcgtggggtgggggcagcggggagggatagcattggtagatatacctaatgtaaatgacgagttaatgggtgcagcacaccaacatggcacatgtatacatatgtaacctgcacgttgtgcacatgtaccctaaaacttaaagtataataaaaataaataaataaataaataaaaatttagtggcttaaagcaacatttattatttcacacattttctgtgaatcaggaattcaggagcagcttagcaagatggggcttggggtttttttaagacattttttagggcagttttagattcatagcaaaagggcttggagtcttttaattcttattttaggttcaggggtacctgtgcaggtttgttatatagataaattcacgtcatggggggctgttttacagattattttgtgacccaggtactaaccctagtatccaataggtattttttctgctcctctccctcctcccaccctccactctcaaataggccctggtgtgtgttgttcccctctttgtgcccattggttctcatcatttagctcccacttataagtgagaacatgtggtatttggttttctgttcctgcattagtttgctaaggataatggcctccagctccacccatgttcttgcaaagaacatgatctcattctttttatggctgcatagtattccatggtgtatatgtaccatagtatctctgtccagtctatcactgatgggcattttggttgattccatgtctttgcttttgtgaatagtgctgcaatgaacactgtgtgcatgtgtctttatggtacaatgatttatattcctttggatatatacccagaaatgggattgctgggtcaaatagtagttctgtttttactatttacaaatagtagttctgtatctactatttcctcaaatagtagattctttgaggaatcgccatactgcttgggcttggagtttttcacaaggttacaatcaagttgttgatcaatgctatagtcatctgacatcttgactctggctggaggatctgcttccaagacggcgtactcacatggctgttggcaggaggcctcagcttctctctatgtggacctctccacagggctgcttgaatgttctcacaactgttagctgacttcccccatagtgactaatccaagagagagagcaaggaggaagctacaatgccttctgtgtcctaatttcggaagttacccccatcactcccacagtattctttgttagatatcagtcactaagtacaaccccacataaaaggagggg

SEQ ID NO: 9385 - DNA, 3643 bp, artificial
  synthetic oligonucleotide
aagcacaaagcatcaaaatactgaaactaaagctagaaagttacagataatgtcaatgcaagatgttattctgactttgtaactcaggactaagaaggcagatagccctcacattttagactaatcatgtttagttaggacttttttgagtaatggtttatttggaggagggagtgattagtatccaaatgttaagggagaagtggcatgggcaaaaatccataatttttaattcgattcaagttccagatattaggtagctgccaatgtcatgccactacccgtatcccctcaggccttacatttcagtaggaccttcaacagtcagtatcactagccatttgcctgagggctttctttggctgtaagccccactctgtcttcagcacagaagactgagttctaggatcagtaccacagttgaagctttcaggtaatgagtgaatggaagtggtgtataaatacccagttcccttgccttttaggtaaaatcatttggagatgcttgttctatgctggctctgggagatccccagcagcatgaacctccagttgctcacaatgataacttaatatatgcctgatattgtcttctttcccaactcatttcctcactcacctacccatgttctctgtacctccagaataaactacttttacttgaatccttgcctcagggcctgcttgtggggaaacccacaacaagacaaattttatattccattttctttaagatcctcacaggtatagagttcataacttatattattttcttttagttttaatatttcagtaaataaaataagttatggtatgaagagttcaaagtgttttgatgacaaccttgaagagctcatcttattaccttattcatgatactcatctgacatgtgaatctgccaatacgtgagaagatgagaaaagagattgatataacagcagcagagcccaatggggaaaagccctggtttccagttctggttctatacttgttagctgtatgaccttggtcgggcaagctgcttaacctctccgactcagtttcttgacacttcaaacatgggggaactaatggtctccatccacaggcttgtggatgttcaatcagataacatatgtgtttaggacaaggtctgacactattaattacgagcagctcaatggtctaactagttacccaagaatactgaatccatggggataccttcaactgtaaaatagaagtcccaactaaacatggcttgcaccaataagaacatctattacaatgtaaagcaagattctgcagcaagaatctcccccctccctacttctcacatttcattggccagaattaaggcatatgcctataaaaccatgaatcaagcttccaatcaagataaacctcctctttctctgtatcctttttcatttcatttctcacactgggccactgtgtgtcagaggactatcacaataagcctcagtagattggctggtgccgggcaaccttagctgagctcattcatatacgtgtggattgggtaatatacatgaggctccaccgagtagctctgcttcaagctatagatctgcaggttgacgaggtagctttttcacctgtttctcattcgccttggaccaccaggctaggtggtgcaaggtcttctcatgtccatgatagagggtcaggtgtgttaagacctaggcttggaactggaacactgcaacttttctgcccttaaaccattgatcaaacaagtcacacggccaagtccaaagccaaggtgtggggtcatagtgtctgcctaccatgaagccaaagggtgtggacgtaggaaggacagaaagggatcagtcattcattctaatgtaacacgttgtcagaacaaagaatgtgtcagtacccaaatggatctgaattcatatagcattcatgtttctgccatgaatttctgcactggttactatattgggatgtcatctggggtcccatgtaagtaagctgttgcaaatgggcctgagagattacttgccaaatgacagggttgcccaggacttagtgaccttccagctctagcatcccattatttgcagtttgtagaagaaaaccgggagaacgtgaaaacccaaagagaagtgagggatcatgtcttaggaacctgcatccttccatcctgcttcgacttctcaactaaattcttaagtcctggagtgcaggtatcaccgaaatttgccccatgcctgaaatacatggtagtagatggtgactctgacaagcgtgaagtgacctgaatctgggggaagtttctgggtgaacagagagcgcggaggatgcgcgggtcatgctggaggcgggtcccagccagatgtgcacagcccgccccgccctccctcgctcaccccgtccagcttcatccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccaggtgagtgtctgactggcgattggcttccccccacccccggcctgaggtcccgctttggggccccatgtctttgcaggcacccccgcgtgtatgggtgtgagtgtgcacgtgtgcctgtgcgcgctgcgacgggatttaacctggataccaggccgggagcgcccacgggctttcctccctgctctcctgtggcggggctttgcacctagttagctccttttgcatcagctgtgccccacctggctgcgtccggagggttgcaggaggagggaggctctgcacgcagacccgtgggtgcgtgcgggcttgatggtctgcagacctgctgtaggggcaggtgtgtgagggttggtatgcgtgtcggtgggtgggttctgtgtctgtgcggttttgtgttttccactctattcacaggacaccaagtgcttgtcagtcgctagttttgctggggaaggagggaaagaaaccgaggacgataaagcatttactgttcttgagctgagccagccgggctgctctcctcactgctctctgattagggttgatgaactggaaagaaaggacacggttgtcagatgacaaccattctcattcttgctatggcaatgcagactctgaagccgttccctactgcccttaagcttagctgagacctgaaatattttttccagagatcggcaaagacgcttagtaaatgcacgcttacatggtgactgtcgacctggcactgttctaagcacttcaggactattaacctacccaaagccataatggctctgtgtgtaaggtactattatcatcatctccgtgttgtagaagagaaaaacgaggcacagagaggtaaagtaatttgcctgaggaagcatagccagtaagagatggagccagggtgcaaacctaggtattctggcccaaagtctgttcttcaccag

SEQ ID NO: 9386 - DNA, 368 bp, artificial
  synthetic oligonucleotide
ggtatatacccaagagaatggaaaacaggcactcaaacagataagtgtacaccaatataaatagcaggactattcacaatgtccaaaaggtggaaactatccattaacagatgaatggataaaccaaatgtggtatatacatatgacgaatattatctggctgtaaaaggaatgaaatactgacacacactacaacatggatgaaccctgaaaacgttatgataagtgaaaaaagccagtcacaaaacatcccatattatatgaatccatttatatcaataggtaaattcacagagacaaaaagaagaatggttgctgttaggcgctagggggcgaaggaagaatagggagtgactgcttaatgggta

SEQ ID NO: 9387 - DNA, 579 bp, artificial
  synthetic oligonucleotide
ctttctccccatctgaaaagagttggtaaaatgcaataagacctaaaaacacttgtttgaatttcctttgtgttacaaaaagaggaaacagaaagagtcactgctctcgtgttagatgctatcatttgatacaatcacatttcctggaatcttatgaactgggatcaccaattgccaagatgactcagagggcctaacagatcacaagactggggcaactcctctaaccttcaaggctttattttaatcctctgggactccacatggaaatccataatagtttcttcaaagagatgtggtccattgtatgaaggcaacttgggaatccctaatgaatggattaggagcacaatggactgcatcacacaaatggaggcactcctgtttaaaaatcaatacactgagtaattcagaatgggcgctgcaatgcagaccttgaaggtcatcgtgaaatagaaactactatgcatccagtccctctatttttcatatcgatgaaggaaagtcacacaatgtgcatggaatgcagaatttttctttattgagctgttcagttggacctcaactctgtgtgtgtgt

SEQ ID NO: 9388 - DNA, 691 bp, artificial
  synthetic oligonucleotide
aatttaattacttttaaagaacgagcaattccaaattccaagcctcagatgaggttcttatcttctttctcaggcatttaaacaggttgctttcacttggaaatcttagcttaggggaaagaattagagatgatttagagtttcttgaatttttttttaaattacagaggtactataggcttttaaaatatattcaaaacagtgatttagaaattataaaacgtgagtcttcggcttgccaaacgattccttcatctcattttctgggggaaattgttaaagagctttcagttcatttactgggaatatatctatacatctgtaattacatctgtagagcagtagttctcagccaggggtgattttgccccccaggggactgttgggaatatcttgagactttttggttgtcacaactgagaagtgctattggctgagtagaggccaaggttgctgctaaacatcctacaacacacaggacagccccacggcggagaaccatcctgcccagaatgtcgaatgccacagttaagaaaccctaacctacatattttcttcatataagaaagcatgaaataggtacgatgttatagaaaataattctgagaagtaaagcaccattgtttcttagacgttcttatggggactctacccactaatgatccagaagaattttctttctctttttaaa

SEQ ID NO: 9389 - DNA, 1416 bp, artificial
  synthetic oligonucleotide
tgtctccatccctggagcgttttcaccagagccctaggattctgaactagggtggctatcactgcatgaaaaatgagaagtccattatggaacacaggtaaaatgtggaaggcttgttgaagactcactagcatgaaaaaataaatgaatcacttggtcgtaacaataatgaacagctaagaacataataaactacagaaagtgaccaccaagcaaagttaatattatacataaaatgcatagtgtcttacattttaaccaaacatagccggatgtatgacaggatgcaagaaccacctgtgggaaacaattcatagccacacaatccttgccaggataattacattgaactgtcaaaggccatggttttggccttccttgggtctttgtgattttatacagacataagagactggcaagacactactggaaccaaaccatagttttgctgattaaaggctaaaacaggctgccctccattgcttctacctcactgaggccccaaagaccttgatctctaggatccaatgtttactgggatttaccactgatgtagccaaacatatggaatttggaatcatggcttgcctattggtctagatgggaagataagccggatgctgtggctcatgcctgtaatcccagcactttgagaggctgagaagggtggatcacttgaggtcaggagtttgagaccaggctggccaacatgacgaaaccccgtctctactaaaaatacaaaaattagccaggtgtgctggtgcatgcctgtaatcccagctacttgggaggctgaggcaggagaatcacttgaacctgggaggcagaggttgcagtgagctgagattgcaccactgcactccagcctgggtgatagagtgagacttcatctcaaataaataaacaaattaattaattaacaagaagataagaggtttctaagagataacatgagaagtcccctattatgatacctaacaaagagtagctgatgcccagtaaatattaaatattccctttcttcttttctcttcctcagctcagagaggaagaaaggaccgtgtgagagaagaagggaacagcctttcatccataggagaagttcgtctatgacaaagccactagctccatgtggccgctgagcactcaaaatgtggccagtctgaattgagatatgttgttagtataaagtccacatcggctttttgagcactttgtatgagaaaaaagaataccaaatatctccttaataattgttacattgattatatgttgaactgataacattatggatatattggattaaataaaataaattattaaaatcaaataaaaaataaaatcaatttcacctgtttctttttacctttttaatatgggtcctaggaaatttaaaatggcacacatggctcacat

SEQ ID NO: 9390 - DNA, 719 bp, artificial
  synthetic oligonucleotide
aaatttgttatttttttcactttacattcaggttgttgtcgcctttcccagggacaccagaggtcctggctttgcttaaagacaaggcttctcaacctcagaactaattaacatttggggaaaatgcacagtgcatattgctaaaccctctacagtgcacaggacagtaccagcccccaccccaacatggggtatatccgtggcctctacccactagattcgagcagcaacctccccacaagttgtgacaaccagtgttaaaagaaactttatacgaattaaatttaatagagtttaactgagtaaagaacaattctaaaatcaggcagcccacagaaccacaataggttcagacctgaaggtctgccacatggttggataacatttacagatagaaaaaggaaagtgacagaaaacggaagtgaggtacagaaactgctggattggttttatagcaccgtgtttgccttatttgaacagggtttgaacagttgactgcccgtgactggctgaaactctgtgattggtacaagggtaagttagtctgtttacataccaagttaggttacagttcagtatgtacggagaaacctttaggccaaacttgaaatacataaggaggcagatttaggccaaacttaattttaacaccagaaatgtctctagacattgccaaatgtcccctggggggcaaaatcacccctagttgagaacctctg

SEQ ID NO: 9391 - DNA, 2264 bp, artificial
  synthetic oligonucleotide
aaaggagcagttgaatatattaatatttctcagtttagatgagagcgaatagttaaatttagctttatcgaagaaacaactattccatgtatcactatccaaggaatttcagtaactttttttatttattgattgatttatttattgagacagggtctttctctgtcacccaggctggagtgcagtggcacaatcatggctcactgtgcagactcgaactcttgggctcaggcaatcctctcccctcaggctctcaagtagctgggactacaggcacgtgccaccacgcctgcctaactggtggcatttgcctgtagtatgctgaagtgccagtaactttagcataatgtttgcatttgcggctacgtatttcctaagtggatgcttctcagcctttcatgtacatgtggaagatgagcacatttttaggacacactagggtaaaggaatagtagggctgcttacaggaggccccacctggccactccagggattgagaaatcagtatctctccaggctgggatccccatcagtttccaggtggctgcttcctgagttttagaacaggcattgtcaaccttggccgcacattggactcacctgaggaactttaaaatatgcatgacctggtcccaccccagagttcctaatttaattggtctgaggtatggcctaggcctcaggatttgaaaaagctccccaggtaatactgatggccagccaagaatgagaagcactgttttagagcaggggtcaccagcctgtttttgcaaataaagttgtattgaaacacagccaccatttggttacatactgcctatggtggcgctcatgctaccacggaagagttcagtagttacaacggagatcttataacctgaaaaacaaaaaatatttactatctgcttctttacagaaaatgtttgctgagcctgttttaaagggaagcttcaggaggactttcagtgtcatatgaaaaatagtttacaaggatttttgctcaaggtagtggcagaattctcataagggactctcacagggacaaaatattcaaagtacacaaacattcaggtaccacgaaggtaaatgagcattcatagcctttcttgttttcccctcgccttacaaggcacatgctgttttcaagtttttgttgaacaagacgaggggtagcaatagggaagtcaggagaaaggaaaggctaggctggtttatgttaggaaaagcagggaactgctcttaggaagaaacaatcctgaaaagaaaaagctacaagtcagaggagaggcagggaggagtgagcttcagggaagagtttgggaaagtttctagagatgggagactagagagctgtcaccctgtgttgagtggcactgtagaggttaatggttctagtgatttttagaaatgtggctgtgtgatatgaatcataatccccttagtctaagagatttctgtaaagttgtatacattttccatacttttttagatgtcagattagtctttttgcagtgaaactctgtactatgattggccacaatggaagctggaaatattgggctacaggatgaatacgccttaaaactaccaattattgacagcatcataatagttggaatagcacatctaagagttagcagcaggaaaataaaaaaggaatgagatgggaatctgaaagcttacaaatggcagcgtgatattgctgggtcagtttccccaactctaagctctaagtatctctgataggaacctgtggagaggagcgtctgctctcctcttggtcactggagcccaagatcgcaatgttcacacttccatttattgtgaggaatagaacaccagcacttaagtgattgtccaaaccaacatcaccaaagcaacagctttgcataacacccttgccaatactcagaatcaagggccttaaaaaatgaaggaaagtaactggaatgaatgcaaatacttgcacctagagaagcctttccggaattattagcaaacactccactcattccctgacttggcaattctcccaaaaagagaggaggggtttaggtacctgcattcctcaagaccctgtatggcctggtgaacttggaggtgatctaggaccaaggtaaatcatgtggctgggcagcctgagaacaaagatcaaatcagaagtcagagaggcagcaagcaaatctgggctgttttacggtatcccagcatcctggactgacaacatgagctggtatttatctctccaattcagatatcagtag

SEQ ID NO: 9392 - DNA, 207 bp, artificial
  synthetic oligonucleotide
accttgtgtttgtcatgcatgcagttaagaaattactttttccctaacattactagtaagagtgagattttactgtgttcttgtttagacataatgtgtatttatcaattgtagtgatatatggatatgcgagtatccaggtaatttatcatattgtccatcactgtaatgctgagatttttgtaggtatcacttcaagagaggaaa

SEQ ID NO: 9393 - DNA, 259 bp, artificial
  synthetic oligonucleotide
agttagtatatgtttatgtgaagaggaaatttacttgctcatcctgaacttatttaatgatgttaagcctactaagttgtaaattaagcaagtttggaaatggaagctgacatgcatttgaggctagatatattgttatagtttttgtgatacaaatatatttttcatgcagttatatacaaagctttatattcagtgccatgtttcttcagacaactgttgaggcttactgtcagctgcactattcttcacttactca

SEQ ID NO: 9394 - DNA, 354 bp, artificial
  synthetic oligonucleotide
actacagtcagatctctatatagttgcagcataccaagagagccatctgctaaggtgcaggcaataaaggaatgcaagtagaatatttagaaacaattgagagactgacagacaatggctatctcatatacaaatggacaatggtcagatcatatatgacaacagaatcctaaccaacaatctctgccaagaatggtcaggacttggtcaatgactgccagcctccctagtttttacctccactttcaactcaggaccaaccagagaaaggcaaatatgctccccaaatcaatcccgtaagatgccccatttctaattacctcacctccagcttccccatgccagcaatctcta

SEQ ID NO: 9395 - DNA, 2138 bp, artificial
  synthetic oligonucleotide
cagtcccagacctgttgccaggttccccttattcagctgagaaattcctcctctcctctcaggtgcctggtgcctctctgcaacctgaaaaccatctcttggatgaccctttaataactacgggataaatgactcatagcactacaccctcccaaagatgcttgctttaaaagaggattaaaatcttaattaaaaaagcaccaaagcaggatttcaggcatgacttagtagaacagaatatcgtgggggccagcaacctctggggattctgaaatctgtatcagttggcaggcaatgtctcatgtcactctgcatgtctaagcacagaaacgtggagccacagggaaactgatgcactggggacttgaattgaattttgaagaatggctaagtagtcagatgagaagggaagacatgttagcatgattgaaagcacatcccaaaggattttttcctcaccgtttcctttttttctttcttttccaaaaatgacttgatataactgactcatgtggtagccagcctccaagattgcccccgtgatggttaatattaggtgtcaactggactggattgagggatacctaaatggctggtgaagcattgttcctgagtatgtttgtgaaggtgtttccagaagagatagatgcatgagtcagtaggctgagaggaagatccaccttcaatgcagggtggggggccgggctaggacaaagcaggtggaagaagggggatactcgactggctcttgctccctcgctctcatttctggagcaggatgccatttttttcttcttgcccttggacatcagactccaggttctttgccttttggactctgggacttgccccaggagcctcctgggcctctctgaccttcagcctcagagtgggggttacactgttggcttccctggctctgaggctttcagacttggactgagccacactactaggcttctctcgttctctagcttgcagacgctctatggtggaacttcacctttgtgatcgtatgaacgaattcccccaatcaacccctttatatatacatatacatatatatatatgtgtatatatatatatacatatatatatgtatatatatatacatatatatgtatatatatatatacatatatatgtatatatatacacatatatatgtatatatatatatacatatacacatatatatgaatatatatgtatatataaatatatatacatatatatacatatatgtgtgtgtgtgtgtgtgtgtgtatatatatatatatatatatatatatatatatatatatatatataaaaaacttgttctgtcccctggagaaccatgactaatatggcttccaagggttctcccctcatggtatttgtgctcatgtgtagtgccacattgaatcagggctggtctgtgtgaccagtggaatatggcggagatgagggtatatgacttcgtagtctaacacacaaagggtattgtgcctactgccttgctctcttagatttcttactcttagggaagccaaccactatgtcatgaggacacttaagcagccctgtgaagagaatcacataggaaaggaattgaggcctcctaccagccagcaccaacttataagccatgtgagtgcattatcttgaaagtagatccaccagccccagtcaagtctttagatgactataggccccgctgacatctgacaatctctgacatctggcttgagatcacaagccagaaccagcccaatcaaactgttccccaattcctgacctacagaaaatgtgagagagaatatatgtttattgttacactattgttttaagcaacctgttacacagcaatacaactagaattcggaaaaagaaatcttaaaatcagcaagaaaaagacaaacaacacaatagggaaataggcaaaagacctgaagagacactttacagaataataataataaccaaatggccaataatctcaatgaaagttgctcaacttcattagctatcagggaaatgaataaaaacatcaatgagatgccaccgcacacccacctgaatgtctgtaatgagaaagatgaaaaatactgcttagaaaagatgtggagaaaatggaactctcacataccacagtg

SEQ ID NO: 9396 - DNA, 474 bp, artificial
  synthetic oligonucleotide
tacgaaaaatatgggttgaatgatttagtccacatggtctctaatcacagggactctccaaagctatcaaaattgtcccttatttttattttttagaagaaagcatcaacgttttactgatgtaaccaccagcttctactttagacacatattttaaaatcacattaaaaccaaagttttttgtttgtttgtttttatttttgtttttgttttgttttgttttttaaagtatccctgagaggtaggtttacttagcagggtctctagggtagtagttaagagcatagagtgtggaaccaactgcttcagtttaaaatccagttctaccataaaccacctgcatgatcttggggaagttacctaacctctctgtgtgaaatcctcagctatgtaatgatccaagtaatctaaattataatgtagaataataataatactgcctgctgaatagggttgttgaaagggttaatattt

SEQ ID NO: 9397 - DNA, 1587 bp, artificial
  synthetic oligonucleotide
ctctactccactgagatgttctcttgggtttactaccaagaacagaggctgtaagtagtatagaatgcccccggggaccccagtgtccaagacaccaacttccactgcctctcaggaccctaaggaaagaaaactgagaggttgttcagcttgtctcaggtccagaactgtctggtcagaggggatcctgggatccaccagttgagcccttcattcagggccccagttattcctagtcttgggaaacccagctctagaagcccctccccagcaggattgaggacaaaggggctagactagagacccagcaacatggcccttccatgttctcaaaactcaagagacctagaaaagagaagggtggcaaagcagcccagccccaccccccagggccagagaggccccacttcactctgtagagcagtgggattcatctgggtgccatttggccctccaggagatgtttggcaatgtttagagacattttaggttgccacagctgggttggggaggcgagggtgctactggcatctagtgggtagaggccagggatgctgttaaatatcctacaacgcacagcacagctcctgccacaaagtgctgcggtgagaagccctgccctcaagtcttggttgggcacattccacccacagctctgaggaagctccgtctggggcttcttcaaagagtcattctgcaaccaggaagctggcagcccatacaactatgcagaaggtgaaagagagaaggcgggaccatgaacacgcgttttaattactgcatgtttgtttctgacagagagaggtcagtgtttgcctccatttgcaggcatcaggaccaaggtgggcagtgggcagtgagggggcaggggtggagggcggcactagctctgtgtagcaggctgaataatggcttctaaagatagcagatcctgatcccggtagccttctatgaaaaaaggtggtctttgcagatgtcattaagtgaagaatcttgagatggggagattatcctgtatcatctgagtgggtcctaaatgtaatcacacgtattcttgagagaaggaggcagagggagatctacgtgcacatggaaaaggtgatgtaacaacagcagaaattggggtgatgaggccacaagccaaggaatatggatggccactagaagctggaaaaggcaaggatcagatactcccctagagcttcctgggggaacgtggccctgcccacaccttgatttgggcctagcgagactgatttcaaaattctggccgccagaactgtgagagaataaactgttgtcttaagccaccaagttggtggtcatttgttactgcagccataggagactaatctaccctgagactcctggggcccccagatggatcctctgaggctgaggggcaaactcttccatgcaggcaaagccagaaaaaggggaatggaaatttcctttgcactttccttgatacatttacatttcccatcccaccctttaagcaccctttcctgtgaaaacatggcacctgccccctcaccggcctctatcagtcaacaattcaactgaatgtcgggcaaagcatatgac

SEQ ID NO: 9398 - DNA, 1091 bp, artificial
  synthetic oligonucleotide
gtgtggaactgtgacctcatatcctaaacccacgttctccattgcaaatccttcagcatccttaccttctgtcttacccacccagaagactcccttcccaaatatgcatcctgcatggtgtcattgcatttgctttcctagggagggatgaagataaaatcttgacatgtgctttgtggtgaggggagaaagcagtttttatctgaggctgaaaggttatatcttgagcctcagacagaaaacttaggatgagtcacccaaggaaagggtcaagaggtcagctagcctgatcttatagagggagacagtcttgtgagtctgactaagttaaaccatgatcttgggtcaataaatatttgcagaatgaaacagacaatttactgatattgaaatggccaggccacttggatgatctccctgagtacagtgtctaactttgagattttatacattatagtaaaatagtggccaggcatagtggctcacacctgtaatttcagcactttgggaggttgaagtgggaggattgcttgagcccaggagttggagaccagcctgagcaacaaagcaagatccagtctgtaaatttatatgtgtgtgtgtatgtgtgtgtgtgtataaaatagcttgggcactctccaagctgactgggactcggccttgactctgaccttgattgctcttattctatgaataattccaaaaagattgattatctgattactcaggccactgcaaacaggaagcgcctgattagaagcaatttgcaagagcaagaggaatatgcaaacacaggcacagtgaaagaggcaaaaattgacagaaatttctggaaaatttgcttatgtggaacttgttattccttgatgatgacaaatggataggtgagaacaaagatagctgtaaaaatcgagcacttccaacttcaagacttgaccttaagaatcttctagtacttaaaaaaagtaggccattgttgacaagtataacactgactactttgggatggagaagtagagatgatgagaagtgaaaaaggctttacacaagtcatggaattgagtcagtaatgatctagggggctggaacta

SEQ ID NO: 9399 - DNA, 868 bp, artificial
  synthetic oligonucleotide
gaattttaagagctatgtatacaactttcatgcaaagtgtcaccactttctattctcatcaaggtgaattttcctccccattctagctgcaaagcaaaactaaagctaaatgcacttccatcctttatacaggcctcatttcagcaatgtttgttgggcacattaatgagcagaaatgacttagctttataactgcttctgaaaatcttgagatttaagtgagaaggaaatacttttgtttctgcctccatcctattttagtgtaaatcaaagttaacagctcatggtctggttggcagttcacaagaaagggcgaggttgccagaaaatcaaaatcacacaatttcctgtttttgaagatgtatttcaacaagatcactgagagcttcaaagacaaaaatggctgtctgccagggccagaccagctccaagcgcctttgtttgctttattgtttgatgctgaggggtcaaagcactctttctattgtgttgtctctgctccccacccctgttattttttttgttgttgttattctattaagattcctgctgaaaattaaattaagcttcctaagttcttctttgttgatcctagcaactaattatagagaaaccagaaaagatttgcaatacttgggcattttttaagattgtaattggctacccacaaagttggtggaacaatagtttttggggaaaaaaagagattcgtactgatttttcaatgaatatttaaaaatatcttggcatcaaaattcctcccattaacctcatttgaacataaaaaggtcccttttactggtgctataattgactttccccaccctattcttccctgttcatcctgacacatcccccacactccgtt

SEQ ID NO: 9400 - DNA, 985 bp, artificial
  synthetic oligonucleotide
gactcctccctattctccttcctggtagttctgtgggctccttcatgctggtttccatgccacaacctatctggaatcttggaattgcagaacttcagaggaaagagaagtctggagtatatctgaagtcatgacaaacaacttcctttccccatagctgataaagaatgggcctgcaggtcccatatgaagggaaggtgtgaacaccctgcatgataggaaacagtttacaatgccctggaggtccctatgattcactgagcagtgctggacaactagacaaaagcaaatatatccacccggttcagggggcttagccagctgtttaccacgccagcagttttcctgtttcacaccccatatccttaatatagggcattctcttaagggacctatcatgtcccttccagtacactcattgtcagtctttccttttttctcctcccttcactctttccacatttcatccaaattgttctcttttcctccccctccaggggagaacaggaggatggcctgtgcctgtttccagtcttaccatgagcacagccagttggtgtttacacatgaaacggaactaactgatctcctatgcatgtacatcagagggaagtacctgttttcctttgaattcaataggcagctaatgagttttccattccttctgatctcaacctgctgtcacgtccactagtgggtgatcttctttctgttgcaaaagaagactttctgaactcctatgtgggtggtcatttatgaaggttgattggtgtttgaaaataatttagaactctgtatgttcatatgtgtatgtgtgtatgtgtaaaaataaaacttgattggcatgacatcatgggtgctgggagtgggtctggtaaccagaataaaaagtggtcttctctgtcccttgtctagccacaattaggagagagtatggattgtcaggaaatggagcttgttccaccctctcactgtggcttaagaa

SEQ ID NO: 9401 - DNA, 2116 bp, artificial
  synthetic oligonucleotide
tggcttggccaaggccggttgtgacttggccccctgccaccattctttgtaccacaggtgtttccaagtaggatctcattcgagttgggagggtgagttagggctttagaccacaggagcagctgagggaaaactgtaaggggccaggcttagccaagaaaagaaggctgagaaagatccaaaccagacagctggctaccattctaacctctatccccaccccagcgctaccacacttcaggccacaccctacccagagtgtggttttcaaaccacaggctgtgtcgtaggaaatcaatttattgattcttgccagcattgaaaacaaaaattaaaaaaaaaaaaagacaaaataaatcactaaaaagaaatcaagcaagaattttcagaactccccagcatggtaagggtaactattgtttatcaaacttctgtttgagttatttatgagggggagagatgactgatctgtgatgtacaatgtttctttcagtgtgagtcagactcacacttgtcaagacttccatcccccagcctcctgcctgcttatggcctcaattcctttcttttctctgtctagcttcgactcctaatcactcacttcagattgattttaaaccctttcctccccatgtccagctgaagtcttccttcatgccccagtcctgaatccactccaagaacctgtttgccattttttcacccaggctcccaagtactaacagataaaatatacactttgccatgctgtcacctcaaaatttgtcacttgttcctggtcaacttactattagctgtgccaccttcagaaacttcgtaacttctatgagcttcactcttctcacctgcctaatgtggaaggggatggccatgacacatggggttgctgtgagagttgaaggaaatatgtacattgtaggtgctcagtatatggtctcctttattattacaacagcctcttagttcacaaatcaatgcactattattacatgaaatacttcttgacctctttgtagccttgtgtgtgtgtgtgtgtgtatgtgtgtgtgtgtgtgtgtgtgtgtgtgtgacagggtctcactctgtcactcaggctggagtgcagtggtgcaatcttggttcattgcagcctctccaactcccaggctcagatgatcctcctgcctcagcctcccaagtagctgggactacaggtacatgccaccataccccagctaattttttctctgggtagctgtgatggttaatactgagtgtcaacttgattggattgaaggatgcaaagtattgatcctgggtgtgtctgtgagggtgttgccaaaaaagattaacatttgagtcagtgggctgggaaaggcagacccacccttaatctgggtgggcacctttaatcagctgccagcatggctagaatataaagcaggcagaaaaacatgagaagactagactggcctagcctcccagcctacatctttcttctgtgctggatgcttcctgccctcgaacatcagactccaggttcttcagttttgggacttggactggctttccttgctcctcagcttgcagatggcctactgtgggacattgtgattatgtgagttaatacttaataaactcagttctgtccctctagagaaccctgactaataaagtagcttttgacaatgctgaccacactctactttctgaaaccctctcctctctcaccatttttagtctctggcttctctattccaccaacatctctgattgccttttctctcttaccccgtaagtgttgttgctccctggtttgaatcttttgcttacctcttttggtgtctgacttcactctacagactagaggctaggtctttagtttctagatttcttttgagttctgagcttcacctcgtcttatctctgcaaacagaaaccccagatagctgctcattcctgctccaactcttgcttctgtttcagggcccagtgtctcagcaaagacttagaacatggtgctactttcttcctctcccaagaagtcatgtgagtcactgtgttaactttaaaaaaaaatcgtaatttcaaatttacagaagagttgcaagaatagttaaaagaattccctatatcc

SEQ ID NO: 9402 - DNA, 3272 bp, artificial
  synthetic oligonucleotide
cagccacccagcagagcattaactaggggaccagacggtcacctgcccctgctcacccccacctccttcctccccaggaaaaaggaagtcaagtagatggagaaacggggaagtccaagctgctggcagtggcattcaagggtctatatataaggttgactctaatccccagcgagacaaaagcctgtgccataaaaatgattagcaaggggtttctaaaaacatttccccaggccacggaaaaggagaaggaatattttgcacactgccttgtctcttagaaataatcacagctaggcctctttataaccggcgagtctttttcctttcacacgccatttgcaggcgcgtggcatggtatttgtaactaattttcagtagcaagtgggtcactggtattcacagagtcaggtgccattttgaaaactgcttccctctacccgaatctcttatatttccagatgcagatgcacttcagcgatgtcctagtgctggaaacgctcccttgaaaatataatttgatttttgaatttcatcttaagacattagagataatgtaactgtagtctttggaattcaacgctggcctccttagccatcacttttaaaatttatgaaaataaggaagaggaaggtaaagaacttcctcattgtccggcagtaaagtcaatggcagagcttgagcttgacttattttgctaagagggaggtgttttaccctataaactccaaattaccttacacccagcaaatactactgttgagtgctcacaaaaattatgctgatgaaacaatatggatgtttcagtgatgaaactttctcttttaaaatcacttaagggtgctttacgtcccacccaaggcaagaggaacgccagcgaggaagacaaagaggcccggggtggggcgcatgcccgccactggactgaaagctgagtcacaggaatcgtacccctgcagcgggccaggccctccagggagggacaccgcgcccttgtgtggagatgtccacagtagacaaaggcagtttcgaaataaaagaatgcctgtcaccccaggtgccaccccgacccttagttattatgcactggtccccaagagcaatttctgcgctgctgttgcaaaaattcatcgtaatgaaataaacgtaaaaggggaaaatgtgttatgaagtgttggagggtgctttgctcatttttttcgccatcgttgtggttagggtgcatgcactagtggaccccgggtgggggtggggctcccctccccaaaagcccggcaggcctccggatgccgttccgagacgcggcgcgaaggagttaagcgggccggcgggtgacatcacctcatttacataggagcgcccataaagctgcgcccgccgcaccccgcccgacaactcggtggtggccactgcgcagaccagacttcgctcgtactcgtgcgcctcgcttcggtgagccccagggcccctgcctccttcctcctgccgtcctgcctccgtccccgccctttcatcatccgcgtccctgtgaaggcattccctaaatccgagcccgagtggttctccccgggaaggctactttggggagctggggggatgcgaaacaccctagatactggataatggggtggggaaatcgatgatttaagaacaaaaccgaaaaactggcgttttgccgtgccgctcggaggggacattaaaaaatttcttagtgtttgcccgcaaaggtattgtgcgttgccttggaggctgagatatgggggaatagacaagtcctttgttctgaggttcatcttccgagccccgagcctcctcccagcctcggacggctgcgcgggctgcatctgtgcagcctggcggcggcggggctgtgctatgacatctttacagtccttcttgcagagacatgtgtgccagggatgccgaattgccgggagagcaggcaagaccggcttcggggcgcgcggcggccgctttgtgtgcggggctgcattgtgacgcgggcgatgaagccggtagggcggtggtcggaagctccagccgcggccgccgcctttgtgagaggactagaaagccggatccggcccgcatccttgcggagaggccgcggctaggaaatggaaacgcttttcctacctgggctccattttaggaattcttgccgatttttcccacttgaatttggaagtggctttcctcttctttccttgtcctagccagcctttaattttaaacgctgtaattaacaattcgcagtggtcaatttcctttattctgcaagattcggctttgagaggcatccgccctctttggtccacagcgttttgaaatatggggaggaggggcgcggggggtgtcgcctctttttctgtagaaagaggaagctcgtgagcgcggaacggcagcagtaggagagcgagaagggtttttttcaggctgcgggtcggagggcagaagtgcagttcccagcccagagacagcggggcgggtggctcttcctcacgctcgctcttggcttgctccctgcagcttttcctccgcaaccatgtctgacaaacccgatatggctgagatcgagaaattcgataagtcgaaactgaagaagacagagacgcaagagaaaaatccactgccttccaaagaaagtgagctccgacccacccccatctttagaaaggctgggtgggagcggccggtgggagggcgggaggctgggagcggccgcgggaagaattcgggaggggggagtgcgggggaagagccgacagttgatgaatgtggcttgcaaaggttaattaaaaatggttttgcagccaacaaacacggggctttagtaatttagtaatggaatatttaatatgccatattaatatacaaacatttatccattaaaatgtatttctatttagtatattcaatatacatattttattccattgtggaataccgtgtagaatgtttatgatttgaaaagatgctttaaatgaaagccctttagtctgtactgaatcctttaatcatctccctccatcttttttttttttttttttctggtcacagcgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttccca

SEQ ID NO: 9403 - DNA, 459 bp, artificial
  synthetic oligonucleotide
gtgtttaaatgaggcggcttctgagccagccagtctgagttcaaatcctgcctttggctttcgttgtgttttcttggggaagttatttaatccctctagaattctctcatctgcaaaatgaggagaataatggtgccactgtcataggattgtgtgaggattcgggaaatactacatggaaagcttcccagtatatggaaagcactcagaaagcacttgctgttattactgctatgggtacagccatgattgttactatcattattctacaacctggcccctgcctggttcccagcgttatttcctgtcactttctctcattttacgcaagtgcctgccaagctaagctactcattgccccctgcgttaactcgaagattctctgcttccgtattgttccctggctgtgtggaggctgagtaaccacttggaggggatgttgtagaggaaaattcaagc

SEQ ID NO: 9404 - DNA, 1018 bp, artificial
  synthetic oligonucleotide
cgttgcacatgtgaccactcttctccatcctgccggcttttcctcctcacttgaacacacttcttttaaaattatcttccctccaaagatgtttgtcgcagcattgtttgtaatttcaaaaaattaggacaagcacaaatgccaatcaatagaggattcattaagcaaaataccacatgcataaccggctacagaacacagccactgaaaaaaaagaacaagacagatctgcatatccaaaccagaatgctagctggaaaaaaaaaatgatgcagaatagcacgtatcatgtgaactcagttttcaaaaagaattctgtacgtaattatatgtcagtatatacataggaaaaatcttgaagaacatataccaaaccattaacaatggtcaactctgaggagtggaatttggagagctttcatctgatgtgttctacattcctttattgggatatttaggaccatgtaataacattatactcagaaaaattttatatacaaaagaaacttcccttaattctatcaatatcatcctctgtttccctttaattttcaccaacatccatccatccatccatccattcgtccccatccattttcaccaacatccatgtgtaagaccaggctggatggatacaacagcccttgggctcaaaacttgtacagtctggtgaatgtaacacggagccaccaaaatgtcatccagcagagaaagtggcaagtacgacagagctttccgttcagatccaagctttgctgctgaatttgggtaaatgactgagcctttatgagcctgtttcctcctctgaaaatggggattatagtaacaagcagagagaacaggagtggtgggtgggtagcgccttaagtaggtgttggtgcagaggactccatcccatctgggccacagaccatcaggaggcacgtggggacttggggacaaagaaaacaagcagcccatatctgccggcaggacctggcaaagtgggcgtgacaccaacaagttgcatcccagaggt

SEQ ID NO: 9405 - DNA, 741 bp, artificial
  synthetic oligonucleotide
ttcaccatttaaatccactcttcacaggaaaatctgaaatgccccaggctcaccagcaagcgaggcctgcccactttctcttcctgttggcagctcagctcctcctgagctagtgatttttttttttaaagagatgggatcttgctatgttgtccaggctgtattcgaactcagacgcaagccatccttctacctgcgactcctgagtagctgggcctacaggcacgatgccatgcctggcaccattgatgtctgagcatttgccttagatgagcagaggagctggactcacagtttaaagtctccttagaccttgaatgcaatgaagcccatcctgactagcctacatattagatggctgtattaaccaggacttttgtccccactatctgtgccacaaactgggcaaatagtagttcctaaataacttactttaagttgtacctgtcatggttttaaaatgctacccacaaatactaacaaactgaatatcaaattcttacccagtagttctatccagtggccagggtgccctgacggtcattcctagctgccccaattgcaaggtccgccattagcacatttctccctgtggattgctaagtgcctgccccagaccatgcctgggctgatcaagagaggcctgattcttgcatcatctctcgggtgtggttgcctgctacattcccaaaatacaactttaaaggcgagatctctagttgactgtatgaacatgttcat

SEQ ID NO: 9406 - DNA, 1667 bp, artificial
  synthetic oligonucleotide
gatggcagttttcttttcctagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaaggtaggagaggtgtgtgccctagaaacctgctgtgggccactgtcaatgttgtttttcctcatttatccccttgattagaattatctggaaaatgttggctttttcctttgatgatcaagtaaatatgctttcttattttgtttgttgaagatttggctttgaacctaccctgacattaatattcaaagaaacaggtaatgcatatttttgcaggtattaaaataccattattgtccttgttataatgaaattattgtatgtctttgtggtggtggatagaactaaatacacacacatacatgcacaagagtacaagtcaaactagagcacatctgaatcagatcactggattgtatcaatttcagggtcctggctgtgatactgtgttatagtttcacaagacgttaccacagggaactaggtaaaaggttcacaggatctctgcgttgtttcatacaactgcatgtctatctacaattcccccgaaataaaaagtttaattaaaaaaaaaacccatgatctctttttaaccttttaaaaagaacagaaatagtatcattgaattatgtttttcacaacattagcatcagaggaggctctgtgagtctttagaaaaaaattgaagaaaatgtggttggtctttgcctttcagagcaacagagaaatcggaggttgagaagaactttgaaggagattgtattagttttctaagctgtcataagaaattacataaaccgcgtggcttaaaagagcagaaatttttccctcacagtttcggaggcccagaagtgtgaaatcaaggaatgggcaggggcacgctccctctgaaggctgtaagggaggctgcttcctcgcttcttccaacttctggtgtctccttgcattccttggctgtggctacatcactctggtccctgcctctctcttcacctggcctcttccctgtgtctcttctctgtttcttataaggacactgtcattggatttcaggcctaacctaatccagaatgaactcaacttaatctttaccttggttatatttgcaaagaccctatttccaaaatgaggtcacatgctgaagttgtgggtggacatgagttttggggggatattgtttgacctactacagtggtcaactcccagctgttgtgtgttccgtatcttatggatagatagatgttcagccaggctcagcgagaatcctgccagttttcaagacacactgctgttctgtgatttggtaactcagtgcaagaaaggttttccccaatatgctgctttttatctccataattcatttctgaaacaacacagatttctgaagcagcacacaagatcccctcatatttgaaaaaaaccctttataaatttgaattcatataccaaagtccccctgaattttaatcccagtctcctcaagacatggtttccattccctgtcttgaagatggccagtcagtt

SEQ ID NO: 9407 - DNA, 6788 bp, artificial
  synthetic oligonucleotide
tgagttgtggtcattttttatatatcctagatacaagaccctcatcagatacatgatttgcaaacattttctcccattctttgggttgcctttctttctttttttttttttgagaaggagtctcactctgtcgcccaggctggaatgtagtggtgcaatctcggctcactgcaacctctgcctcctgggttcaagcgattctcctgcttcagcctcctgagtagctgggattacaggtgcgcgctaccacgcccggctaatttcttctgtatttttagtagagacggggtttcaccatgttggtcaggctggtctcgaactcctgatctcgtgatccgcccacctcagcctcgcaaagtgccgggattgcaggcgtgagccaccatgcccggccttctttcactttcttgatggtatcctttgaagcataagtttttcattttgacgtccagtttatatatttttgttggtggcgcttgtgcttttgatgtcatattaaagaaatatttgcctaatccaaagtcatgaaaatttatacctatgttttcttttaagaattccatagttttaggctttaagtttaagaattccgtagttttgtaaagatgccatctctacaaaaaatacaaaaattagcttggtatggtggcgtgtacctgtagtcccagctactcgggaggctgaggcaggaggatcacttgagcccaggaggtcgagactgcagtgagcggtgatcacaccactgcactccagcctgggcaagagagtgagactctgcaaaaaaaaaaaaaaaaagaaagaaaaaagaaaaggaaagaaaagaaaagaaaaaaaagaaaagaaaacaagaaaagaaaaagaaaagaaaaaagagaagaaaaaaagaaaaaaagaaaagaaaaagagttttatagttttagctcttgcatttaggtctttgatcaattttaaattaacgtttgcatacggtgtgatgtctttatctttttacagatatatgcaggctaaataatttagaggtgaatatataacatctgtaatttactttaaaatactttagataaaaacagataaagcaaacatgggaaaattttgacagctacaaaatctaggtggtgggtatatcggtgttcactctattttcatctcggtttttggatttttctttaaacaacagaagtaaaaggtaaagttctagaaataaaaatcagaaaaattacttgattctgagtgaaaatgttattaatagagaattaaagttgaatctattttaacttatttttaaagtacattgcttataaatgttagcatttcataataagttataaattatttgccacacccctaataaaaacatacaagaaaaaggttatgtcagagtgtcttggcattgctcttaggaactagtgttctagaacttcttgttctaatacagcaactatcagccacatgtggctgatgagcacttcagatatggcaagtccaaattaagatgtgctgtaagcgtaaaatctatattggattttgaaggcttgacacaaaaagatgcaaagtagctcattaatatgttttatgttgattacatgttggaatgataatattttggatattggattaaagtgtattattaaaattaccttcacttgttttttatattcttttaaaatacagctactaaagtgtaaattacatatgtggcttgcattatatttctttttaaaaagtttaaaattttttcatagaaacatataggaaacaatcattacatttcttttggatggtaccattctagagagaaaaggactggactagaagatccacattctaattcctttgctgctttcaactagccatgtgacttggggaaatttcttccgtttctcagccctaaaatagtcagggataaattcactcagcaaatacttagacttcttactatatacaaagaacttggctagatgatgtgggaaatagaagacgtgaaactgttcataaattcaaatcattgttttaccgttaatctctatccatgagtcaatgaagatagaaatcaacaatagaaaatatctcatcattttaattttttccactaacattttatcttaagataatgtatattttataaacggtctgagacccagatcacatatgcacagagtatatgttctttttctcttctaagtcttgggtctttgaacaagtgttccatttttccagaggctccccaacttcaaatgttgttcaagaagtgcactgtggtagacagttggtggacagtactcatgccctccagttgtcccataccatgttgacagctggtcttggccatgtaacttgctttggtcaatgagacattagcaagcaagttaaaaacagaggtttgataagcacttgctcattgagacttatcttcttggaacactccttggaaccttgcagccatgccgtaaggaagcccaaacaaccatgaagaaaggcccacatggaggagagaagggccaggggttctttcaaactagtgattctcaacctgtggtgattttgctccttgtaggacatttggcaatgtctggggacacttttggttgtcacagtggtggataggtgctactggcatctagtgggtagaggcaagggaggctgctaaacaatctgcaatgcacaggacagtcccacaacaaagaattacccagcctaaatatcagctgtgctgaggttcagaaacctgctctagaccaatgtttcccacaacctggctcctatggatcaaggataaaggcatttgggagagaaagttttcacacttaaataaaattatctgtagctgctcatttacaagtgacagctttctgaacagtctgtgactcatgatgatttttcaatgattcccattagtattctcatcaaccccaatggcacatttcaccttgtttacatttagcatttaagcagagtaactcatcaaactattgaaccaacaatcattgtattagttgccccaactgagatattgtttctccttggtgctatcaagtccatggtttgtcacaattcaatccgagcttccaaatctgcagccatttacccacccaaagaccaggggctttaacttttactgttttatagtccatcagctttggttctgtgttaccaaagaaccacagccccatcatgctaagaggatgccactttccctttgagaagagcatctatatatttagaagaaaccattattagtcaattttatctatgagagaaatattaagaatataaaaattatagtaatttgctgatagtaaattttattagaagagtttaaatataactacattagcagactcaataaaaattttaaacatagtgggtcaagtataaatctcattgctatggtaattagctgtgaaatacatagataataaaccattgcagataggggtttttgtttgttttctcacataatagggcacatatgcatctctaggcggaatgaaaaagggccagaaatgctgctaaaattgtcagtttgaataactttttgataggctggcagatacaaaagtttacaagaaacactcgatgtgccaagtaatctccttgcaaagtacaaggacccagatgaaaaatcccaatgatgcgaatcatccctgtaatctcccaaatcccattatgaagtctgattagagtaggctacaacccaattgcaagtgggctttgctgttgatggagagccaattcgtggcaaacattagtaaaaccaagccatttatctacccggttgaatcagcctttgttgaggagtgtgaaactgtgaccagcatcaccaaccagccctctatagacagggactgctttcctttctcctacacttggtttgtgccctgaagttggctctggtactgcattggcatcttgagaaaacctttttgctggtttctagcaggaaagagaggaaggaggccctgactccagggatgtggagggactgagctggattgtctagggagatctgtgttcctgggatcaggcccttgagcacccaacaggcagaaggttgtgaagtgccccaaggaccatcacatctaccgaaaaatggtgaatctgggggacttggtttgatccagtgagccaccaagagcaatacttcccctcagcctgtgatgaggactcacatagtggttggattttttaaggacacatggtgcaggggcaactctgtagttcaggggtcatcaagtttgaactatgagggaccacatggccaatatttacattttgcagaccaagcaagaaaagggaagatattacgtaggaacttacataacaagagagaaaaaattgtcacaatgtttttattgatataatccaaaatacggtaatatttgagtacaattatttgcaactcacatctattaatgagagaaaaggaattcttttgcgggggggatatttctcttaattggagttcaaaggcggtgtctgctatcatcacataaagtgcaaatgttcatgtatgaaaaccatgcttagctctctggtacaaacacagggagctctcgcgatctggcccataggctgtagtttgcagacccttgctatagctgaacaccagtcgcccacactgggtttgcggtgttccggggtgggaagtcgctccgggctgcgaagcacctcgagggatccccccggcccgaactctccctctgtgcccagctaaccgcggttcattggctctccccgcgaggcaggtctggaagatcaagaatgaagctcggagctctctcgcggagcaaggacaccttcgggcttcaggaccacccagggcgtccaaaactgctgccagggctgtgcccccgccccccggcactttccagctccccctccacgcccgctcttcctccctctctgccccctctagctcctcctccggctcctccccctccgctcctccccttccctacatctagccgccgcgctttcccgctcccgcagcagcagcctcccgcgtcgctgtcgctgttgcctccgccacctcctccgccgccgcgcgcccctcggagttccgcgccccaccatgcccaacatcgtgctgttcagcggcagctcgcatcaggacctgtcccagcgcgtggccgaccgcctgggcctggagctgggcaaggtggtcacgaagaagttcagcaaccaggagaccaggtgggggccgcgccggcggccgggctagggagagcgctgggcacgcggctgcggggccgggttgggggccggcgcctgcccgggccacctccgcggacgccgcgctcccccttccggggcgggacggtggcaacgcggcctccgcgcccccgcgcccgcgcctgcgaagaaaccgaggcggggcgccgcgcgtcccgatgcgcgcctcggctgtgcccccggttgcagggcctccggtcctgggaccgcggcgacccggcggtcccgagccgctcccggcctcccagcggtgccgcccggcctggcgtccccagcccggaagggagacgtctgggcggtcacagaccgtcggggagagagtgggcgcagcgggcgggaaccgcatcgggtcagcgcgcggtggagagacgtcctgggttggctggtcccagtttccgcgtccctacaaagctgaacctcagaccagtgcgtgcgactaaaggtttccccccgtccccaactctggttgcacgctgggtttacctggggacggtccgaacgctgcttcccccgacctgcccccaagggtttgatccaacgggcggaggatcagcgattttacaagcttccctggcttctcctgagcagccagggcgcagaccactgcgttatccagagggtgcagttgtgccaaggtttgaaagactgtgagaaccccaggacgcacgtgctgggctcccctctgctcccactactcttgctgctttaaagatgatggactttcagcttccttcttgttctaggactctgctgtgtccagcaacaacgccgtgattcgactgtaactttcacccatttctcaagtccaggagagcctcaggtggtggccatcctcggaagctgacctggggggctcctttgtctatctgcctgagtccacacagctccttgactcatttcaaattggtctcatttttcccccttcttcctccaatgtctagtaccgttaactgtccacagttactgataatttttatatctttggcaaaggttcaattttaccaacattttctagaaatggtgttggaacagttggacacccatatgccaaaaaatatgaacttccatccatacttttcaccatttgtaaaaattaactttgaagtggatcatagacctaattgtaaaatctagaactataaaatttctagcagaaaatcttgacttggggttaggcaaaaatttcttaaggaggagttatgttaatactgatggggaagatgctatattttggcaagtcagctttttaggatatgtgaatcttacgtgacttcttccaggtggcaaattccagttatggctccgatgataatataagcgaagaaacattgtgaatgagtggcaggtggactttggctaaagaattccactctgcagtgtttaatgcagaagtctgagaggatggtctagggctctggagaaggatagagctaggtttgagtgttgcagtattttgccagtcttgttcaagtttcagtcgctgtaagaacacgagaagaagaatagtttttgttcagaaggtgtcgtcatataagtaaaggagaaatttgttgatg

SEQ ID NO: 9408 - DNA, 348 bp, artificial
  synthetic oligonucleotide
gtatccctatctcaccacatattctggagtcctgcccaagcagatctgctctcaggagcaagccactgataatccctgcgcattgcatcttcctccgtgtatgcggcaaacctgaatgatcaaaggtcatatttccagccatagcttctgctagctggccgtggcatccaggctgcccgtggtctttcatgcacctcgttatctaaaatccttaccttgtctatttccaaaggcatcgagactactcatgatcaagcagaaggcgcagtggggtaattagagaataaagagacccatgtgaagaggacaaagggagcagagaattattgtgcagctctaaatttcctg

SEQ ID NO: 9409 - DNA, 1743 bp, artificial
  synthetic oligonucleotide
agccagaacagaaaatgaaagggaagacttaaagaaattccattttagcattacaataagactttgtgggactaggaacaaaataaatgatttctactttttttttttttttactttgtgggactaggaacaaaacaaatgatttctactttttttttttttttttttttgagacggagtctcactctcttgcccaggttggagtgcagtagcgtgatctcggctcactgcaacctccgccccccaggttcaagcaattctcctgcctcagcctcccaagtagctaggattacaggcgtctgccaccgcgcctggctaatttttgtatttttagtagagacggggttttgccatcttggccagactggtcttgaactcctgacctcgtgatccacctgccttggtctcccaaagtactgggattacaggcgtgagccatcgcgcccggctgatttctatgttttaagaggggatttgtgggttttgatcactgctctgtatatctgttcattaaacataggaagtacacaaatactgaatgactaaattaataaaatgtagtagataaaatagaagaggcaaaaggaaccaatgagaacagaattagtggcctcaaagtacgtagactaaagatgccaaacaattaagaaagtgcatgtcaaaaccacaatgagataccacttcacacccattaggatagctgttatccaaaaaaaaaaaaaaaaaaaaaaggagacaaacaacaacaacaacaataaaaatcccagaaaagaacaagtgttggtgaggatgaggagaaattgtaatccttgtgctttgttggtgggaatgtaaaatggtgcaaccgctgtggaaaacagtatggcagctcctcaaaaaattaaatatagagaccgggcacggtggctcacacctgtaatcccagcagtttaggaggcagaggcagatggatcacctgaggtcaggagttcgagaccagcctggtcaacgtggtgaaaccccatctctactaaaaatacaaaaattagctgggcagggtggcgggcgcctgtaattccagctactcaggaggctgaagcaggtgaatcgcttcaacctggagggcagatgttgcagtgagccaagatcacaccattgtcctccaacctaggcgacaagagcgaaactccgtctcaaaaaaaaaaaaaaaaaagtaaacatagactaccttatgatccagcaattccactgctatgtatatgcccaaaagaattgaaggcagggagttgaacagatacatgtataccaatgttcacagcaccatttttttaataataataatcaaaaggcagaaacaacccaaatatccatcaacagatacataaatatctgacttgtgctactatctgaatgaacatggacgacattattcaaagtgaaataagccagacacaaaaggacaaaaattgtatgagtccacttatatgaggtacctagagcagtcaaattcacagaaacagaaagtagaatggtagtttccagaggctgagggaaggggcacagagtttcagtttgggaagatgaaaaagttctggagaaaagatgccaaaacagaatttatgaggagcaagataagatacacaaagacaagagattgtgaagacctaacatgtcagtaacacgagttctagaggaaggaggaaaagcactaaaagaagatgaacaattaaagaaataatagaaggctgatcttcctggtctgaa

SEQ ID NO: 9410 - DNA, 258 bp, artificial
  synthetic oligonucleotide
actaagctagaagtctctttatgcatgtggcaggcaaaatgtaagatggaccccaatgatctctccacttgtattcttagatttgtgtatttccttcccttttagtttgggtggggcctgtgacttgctttctaaccaataaaatgtggtaaaggtgacgggatgtccatccatcattatgttacatgagattgtagctttcatcatgtcagcagactccctcccttgctggctctgatgaagcaagttgccacgttg

SEQ ID NO: 9411 - DNA, 293 bp, artificial
  synthetic oligonucleotide
ttattttttattgaatgtcttccctctttagacggtaagctctgccaggttaggtgttttattgactgttttatttattgatgtagctcaggattcctcaatctcagcactattgacattttgtgctgagtaattctttgttgtgggggctgtcatgtgtgttgtaggatgttttgcagcaactatgggttctacccattagcacttctcctaactgtgacacccataaatgtcttcagacattgccaaatatcccctatggggtaaaatcactctccactgaggatcactga

SEQ ID NO: 9412 - DNA, 1416 bp, artificial
  synthetic oligonucleotide
actagaattattctcatcaatgctgtctttcccaactctttccagtcttccttcgtagacttctctcacccaaaagccactcaccactcatcttgtgtcctaattatacttgctggtatacttttctctaagcagaccccatgcatccctgcctgtagtcctcttttcacctacactgcccctggaaactgcattcctttcaagtgcttacccgttcatcaagatccaactcaaacacagctttttcagtggttctccaccactttccctcctatatctcgcatgttggagtcactctcttcttgttctgtatttccaagatatctatctgtagtcgctctgctttgcaactgtcaaattctgccctgccaggtgaagtgggtaaattacttggcctttcaatgcctcagtgtaatcaactaccaaatagagaaagtgatagttacctgtcaacgttattgtggagattaaaagaaacaatatgtgaacatgcttcagaacccaaagatgaacacaacatgtatctttattgggcagctgtaaggaacaaatagagaaaagcaaaacctttttatgggaactttgaatactgataatgactttaccatggatagaaggaaaggacattggtgcacatagcctgggttgtattcctggctccacttcaaatgagctgcatggccttgaacaagatgcttactcgcattggagaaagcccatttcctcatgtaaaaagtggaaataatgaaacctaccttgaagagttactgatgactaatgcatggaagcagacagagctctgataacttgaactgaaatggctcccgatattcccttatcatctctcacccaggccagtaaggttggggcacacaccccaggcaagaggcagtattacgtgacctaacaaggtctgagtgagggagtgactgtcagccccataagacgggattccatcctgggaggctgcactgctgacttggacaagtgtcaagatcctgctttaggaatgataggctcagacagaagctctgagtacatgcagcgtgcgtggggacagagagaggagcagttctttatgtgcccttaaagtgagccaactccatgtctgggctagcctctcctctgtgtcttctagaatgctttccctcatggctctagggacaagaattagtaattactgattactaataatttttaatgattgaataacaacagcagacaccaccatttatgaagatatgattcagggctgtgtatgtcacatctctcatatgctatctgcctactttatccttcccctcctgacccacattctaccccagagttgaacctgcaactcggtctgcagcaaggactatcctaggagtggataaatctggtaaatgagaagatatgaggatttcttctggcacc

SEQ ID NO: 9413 - DNA, 1580 bp, artificial
  synthetic oligonucleotide
tcgtattacagtatacagatgttccgctgtcaacacagctgaatacagtggactatgatgcaatcgcctgaagtgggctgcctttacctttccagaaacaatgtgcttttattatttatttattatatatgtatttatatgcttactgtaatggactcatattggatttattttcagaaaaaaaggggaattatcttccatgccctttcttcataggattttgcaaatcagtaacaggattcagcagtaaagtactacacttaggagcacagactctggcatcagactgcctgaatctgactcctacctctgcccctttttagactttttagcttccatgttaaattccctgcatttcagtttgatgtaacttctctacatcttctgtataatggggatcagagtagtatctaccttgtagggctatggaaaggatgcaataaattagaagagtgccaggcacatcctggtcattccatagatgtttacttttattgttattgttatttaactctaaaatgtttggccagttgagtgtctcaattaagggaaacgaaactcaagtagcgtcctggtatagattttaaaatttggtttcatttttcgtttttcattattttgacataatatgccccagggcaagcaccacaaataattaaccactttagacttgtgctatctgctaaacttttttatttcattaaatgtagatcatattttagttctctgtgtaagattgttgagctcgacacaattgagaattctcaaaacagatctgttgcttcttatgataacatgctttgtaaaaaaaaaaaatagaaacaatgtagatagtatagaggagaaagtaaaaaaaaaaatcacctaaattcctactaccaagatatagccattattgatgtagacagcaataatatgtatagtagatataattccgtgcatacacaaacacacatatgtaatacatatgagatcatatattttacacatacataatacatatatatagatgtatgtatgtatatgcagacacattttttcctaaatggaataatatttggcatgctgttttataatattgggataatctaacatctctgattatgagattctccgaagtatgtgtcttcccaggagctgaatgaagattcaagtcttattttttattttttggtatcatctcactgtttctacaacctctctccttcctggccctcaattctccttagcttcaaagacactaatacctactcttacacaattttgagaagagtagaaaaaaggtaaaaacaaaggtcaaagagtactatttccagttattgttatgagtgaaaacattggtcaaacaagctgtgtctatcataaaaatgactctacagaagtcccaagtgatttcagtgcgtgactagattttctgtagtaggcaatccagacttcaaagtaaaggccatgagacagttctcttgaagtgtgccactgttttgtattttggatgggacagtgtgtctcttctccagaattcttgattaaagttgcttgattagacaagaatagtttcatttgatcaaaaagcatgggtc

SEQ ID NO: 9414 - DNA, 848 bp, artificial
  synthetic oligonucleotide
ctgtccatcacatttgaatatgtaaaacaccttttgggctcacaccagaagttaggaaccctctggatcatacagaacagaaatccttacattttttttgcttttgtagtcctgtcactaaaaaaagttttgaacatgtactgccccaaatgtgtattaatttattcataatttatatatctgtactactgtaaataatatattatggagaatataaaatatatgttaagaggtgttgaaatgaaggtaaaatatacattttaatcactcaaatattttgctatcactgctgcattaaaaaatcaatattttaaatgataaagtggtcaaggatgctgatttatttttgaacatcttggtttaacatttcattgagtaaaaatgtgaaggtctggttgcaagttcagcttatttctttatttggttttaatcattgtcattggaggaaaaaaagaactgcagaaacatatgaagaggcaaacggacaaagtatggctccaacttgcttactagatcatgaaataccatttttcaatcccatctatgcaagagattttgttgacattcgtctggaaagtttccatctcctttgatgtccgtcagctgttcttacaaaccaaatggaagatattgcctttttattatatttaacaagtgagttcacaatccactgaaatgcttcatttggaagattgttaaacaggttagacaaatccattttcaagttttcaaagactgcagtttttatctatgcatatttgcataattttcaataaaacaatcaaataactgttgttatgtctaaacatctgtttccctacattcagaccacaatccaagtttatttt

SEQ ID NO: 9415 - DNA, 981 bp, artificial
  synthetic oligonucleotide
ctcagaagtcagggttgagaatacaaactttagcttactgctacatagttttccaatgtggtcataccatttattctccaggaacagattttgataagggtattcaaagtgtcctatagcatctctagaattcaattcacagtggcttacactcatgtggatagcatactgtttacactgattattataataccaaacagagcatataattcagggtatttattgtctctattacttgtctttttaatttataatcactgataagtctcaatctaagcttcagtgttccttgggagcaatgcctatctggggttgatggtaggagggaaggttgagagctaccagctctgttcagcatctctatcaacccatgggtgtgacttgattattattgcctctgacacattagagtatcattaacataaaagtcatctcttaaacacattaaactgaactcaattaacagaattgattaccagcctaactgtagggattttgcagctttagggaaactgacaaacatcttgcccttttagatcctacaatcacattcacaaagcacggtcaataaacattttgccagctctcaatttatcgtctttaacgaggacaaaaatctctctgggtggatgaactggctgttgataaaagactaattgtggaaatggttttcagtagtggtattgacaaatagaactgagtccttgaaggataaatttgaccatgaattaatggaacctgtcttggatgttaatttgtacaagccctaatagatctttgatttattgcatctcattttctgaagtggaaagcatgactggaaaaatgtatcagtctagatgtataaacctcatggtcctttgaactgtaaccctcaaaatgaataatattctgattcataaataacattaataacgtgtgcattccatttaatgtttaagaactccattaaccttagtttctaagatattccactttttc

SEQ ID NO: 9416 - DNA, 1300 bp, artificial
  synthetic oligonucleotide
cacttctctttctccagtgtaattctgtaactgccaattagctttgtaattttaaatgataaattatacatttctttctttttctttctactataaatagcatgtcctgatattagtaattccacttagtgagatgaaaatataattcttgtacccttcttgcttacttccccttatcctttctttttccaccttttgtcttccatagttagtctttaataatacaatggttgaaaacattcacaattgttccataaccattacgatgtctttcatgccttatttataggttgatttaaaatttttaaactcactggagggtttttattcttagtactaaggaaatattattcaccgtatagctaattattgctgattataatgcctctattgaaaagggatttttgttgtttttctagcagtctctgacagtttttcattttctcccttgcatgtcctgtgttaaaaatgctttgtccttcttaaaaatagagtcaaatctctggaaccaccttctttcccaggcacctttctcctcaattcttcctcccactctaacctgggttgatgacttcctaggcctcgttcaagactggcatccttgattttgcttccttctcctcctgtgttggatccattgcttccttaatcccatgtctttctatttcttgattttgttagagcacatcttcagatcacttgcttcaaaaagatgtgtgggaagtaagcgttctaaatttttgtgggtctggaaatgtctttattctgacccctcacttaacctagaaatctagattgaaaatgatttttccacagtagcttcagggcaagctacattgcctttgggtctccaggtcccacagtcaaataatgatctattctcattcatttatcctcaatgtatcttttctctctactgttttaaggataatttatttatctttggtatattaaactttcattgtgatgcttccaggtgtaaagacatttttattgtcaagctctcaggctgagttttcagatcattcagctcagggacttttcagattcttttttaaaaataattcctttctcattattgttctctgttttctgttttagaaattcctatcaattgtttattggatcttctgaattgatcatctataaatgttttcttttctctcgtgttttgatactttgtctttttactcaactttctggaagatttttaaaatttttatccttcaggctttttattgaattgaatatgaaattgtttaatttctaagaatattccctcggtctcatgtttcttttt

SEQ ID NO: 9417 - DNA, 1097 bp, artificial
  synthetic oligonucleotide
ccaaattagatgttgtttatgcattcacaatggaaaatgtaactttccaaaggaatgaatattcctgtcttctatccaggtatcaggaaagttgaagtagtaaatgggggtgaaaaaaagaaactgcttaaagagcactgagtcaaaagaaaataaattggatagtcatggagaatatttcatccaaggtatagaaatgcctggaataactatctcccaccctaacactaaaacctgactttagtgaaaaaatctatgtagctctgtaatatataaaatgttgctgtttgatagtgctaaatgaattctcaaaatcggttttttccattctactttttctagacactcttcagaccattcttccaattttataatacaactattgtctcagacttcttacaatgcaactgagtagcttatagcccttgagaacatcttagttttcttaattggattagactgcagactctagcctatcttcagggacacatttcaaagccatctactaaggagagttacttcagtagatccattatgtattgttttgagtcatttcagcttccgggacaatcggtttctgaccttgtctctaaatccttgtggtcccccagtggagcccacgtgcagggatcgtgagtcagggaccggactgggcatgctctgttcagcttgctagcagatgtttagctttctagctccattgtaaagtagtaatgcttttcatattttatttttttaaacccatagattttttttagacaaaaatcaatttcttgattcatcagaagctgattattgagttagtaccttttctgaattcttcctggacagaaagttgaatccagtttgcttcatgaatgcttttttacagtccaaaggtattgacaataaacaaaagaaaaccgaaaagactttcttgtcacagctccagaaaatgatgagattgaaggaaagaagacattaaaactaagggataaaatgtctttggaaaataaaactttactccattagaaggaaagctattggaataggttaaaagttcagattacagatttgtttaaaaataaaaatgaatttccacttccagtatggccaaa

SEQ ID NO: 9418 - DNA, 1997 bp, artificial
  synthetic oligonucleotide
cacagagtggattcctaaaatgtgcacactcaaatattctctatttcttatgttgatattgactgttctcactttcccataaagttagattattcaaatcatagatcttcatttacattctatagctgaagttaatgtaccttttcttgattaattctcaaaacaagtttatattttgtataagatctctttaatatgaaagctcatagtgtatctttatagataggtgtatgttttctctgtaaatttgccaacctctgcatctggttcagaaaatggaagttctgaatcagagctacaaaaagatttaatgggcttcatgctgctgttagcggcagtatccaggcaccaatagaccagtatttcccaaactgtgttttgctggacactagtctaacaaaagctctgtgaaaggaaattcttccaaggaagagaagtttggaaaactctgccttactttctacctttttggagaatcgcagtgctcattagcattatgtgtgtaagtaaagaaagctttttcatgctcccagttcagcattttccaaatacattggacaccataacagtttttaaaactagtagtactctgatctactatttaccataaaacccttttctagatgtagtcaattgtcagaatgtcattgaggcaaccaacatatctaatatacaaagttagtgagatttatgtctcctaacctgagaatctatgactttttgttatcctagcttaaatatttacatatgtgacagggtcaatcctagaatcaaaagaaatcatatttatgtctttcttaagtacacactttggaacttggagaaatacttttctaacagagaagcaagtaattaggtgtaattacacattggaaagtggcaggtatgtagatagaggcctcaaacacacggatccttttaaccataattaaagtatataaaattgatagacaataaattttattataaagttctgtgttgaatatggaaaataaccaagccaaaatgtaaaaaaaaaaatccttggactgacatcataatgaccttaaagatgttagcatgctctttgaagagtaaaactcttctgaatatttaaaaagatcatgatatctatttatttttcccaggaaagagtgtaatgatttattttggattcactgaggtatactgctactgaatatttcagaatagcatgccaagtgcaaaaactgtagtactgtttgcagcttcaattttgaaagcacttttccaacccatttattaaagagtatccattttctgagccaaatgatgtaacaaaaaaaattgttctctgtatatacacagcacttttttttcttttggaccttgggtacaaaagattgatttaataatactcctcaattcatagaacataatcatacttgatcctcataaggctttctgatacacgtactcatatatacatttatgtacatctatgtgtacttactttctcttttagagtgtatataagaatatagcaaatatattcatatatatgcatccatattaatatattcccttttatattgtaaatatatacgaatacataaaatatgcatatgtatatatatatcatacatatgcatttatgtgaatacatatgcatattttatttttctgtctcctggagaaacactgtttcatatatattctattatttttatgtgtccttgataaatatgtatagttttctgagcatgttgtcttagtttatcatgtaaacatatttacatatataatgtttcttttttcattcaatactatagttttagaaataacttttgactttgaaaaactgcaaacataaaccaagtatgcaatgagagaagagtacactgaactcccatatgcccatcatgcagtttcgacaattattaactcatgactaatcttatttcatctatgtccccacacacttctctcctacctatactacttgacacaaagcttagatatcatgtcattttatcaag

SEQ ID NO: 9419 - DNA, 1277 bp, artificial
  synthetic oligonucleotide
gaaatttaccattttaaccagttttaggtgtacaattcagtggcattaagtacatccacaatgttgtgcaaccattcgctactatccatttccagaactttttcatgatacccgaaagaatctttgtacccattaaacaataattgccagttcctccctccccttaccccctggtgacatctattctactttctgtctccataagtttatctgctctagggacctcatacaagtgaaatttatatattttctgtccttttgtcactgacttctttcacttagcgtaacgttttcaggctcatctatgctgtagcacatgtcagaagtttttcctttttttatttttcctttttaatgttcccttgtgtggataggccacattttgtgtattcattcatctgttaatggacatttgggttgtttccaccttttgtctattgttactggtattgttatgaacatcggtgtacaagcatcaatttgagtccctgctttcacatcttctagacacatacctaggcgtggagttgctgaaacatatggaattgttgggtcaaaattaaaggctgtgtttaactttttgaggaaccaccaaactgttttctggagtggctgcagagtggtttttttgtttcgtttttttgtttgtttgtttgtttgcagttttgtgaaaagagcatttctatttctcaaaatggcaagggtccatactgccctttttctccaacctgagcaaaatatccttaattataagaaattcatgaaacagatttgaaatcaggaagtgtggttgggtctatcctgattataatagaggagagattggaggccagaaaaaaaaattatttcacaaccacatgctacattctttgttccagccaagttgattatggactgattagccaaacaccggatcaccgtgaggtgaggggtcatttttataaaaaatatctgccaagattgtttctaggggatttggtcttttgtaccaacccccgcgcaccaccacatacaagtgaggattgttggaaagtatcaacagggacaacacatgtgagtgttgtggacagtttctcagtctctgaagcccaaatctctctccttccctagaattgctgcacaggggacaggactcccaccccttcagagcacagtttctttctgacgtacttaactcctgggtccatcccaggaagatccagtatgcccttgaacatgactggaaagtggccccctggcttcccaaggctttcctaaggatatgctcacagagatac

SEQ ID NO: 9420 - DNA, 1056 bp, artificial
  synthetic oligonucleotide
tcagatccatgtattttttttgtcaacacattaacagacatgtagccatgtttgatcttaattattcaattatttgttttgtatcaggggatactccttgagctagattcagttgatttgcatttgtagagttttccagtattggcacttcatttggtattttatgacaagaggctttatttgaaaacatcttgctaaatggttgttagctgcttcctgaacatactgtacaggaaaatgtagtttataataaaattcagccttcctccaactcgttattataatgctatattttacatgtaaattatattaggaagcctgtgtctttcctttagtgattaagatttcatggaggggaagaagaatggaaaggaaaggaaaaggaaaaggaaaggaaaggaagatagtttatttgttttcaataagttagcctcctctggggaagataaactttctgacaccgaacataattgagtaagccagaataaattgttgcattctctacataggcctcctttcactcacaaggatattctttgtgccatttctaactgtactattacttttggaaacatttttaatagaatagactgtgttcatacctgtaagtacttttcttgataccaccttagaaagcattcaaatgcattctctactagcgtagagaaattggtgggtttttttggttttgcgtgtggtttttttgttgttgttgttttaatagtacctcagggtagcaaattcatgtgttctctcactgcagggaagcagcacattaaaaaaaaaaaaaaccaccagaggaaattgccactgctgacttttgtgcaaagaagaggaacaaaatgcttgccatgtcttttagtagtcaatgggccacagataatcctatggtggcattctacatttaccaaaccagtattaaatttgtgaacactttttttccaacagaaaaactgttcctacatcctttatgaaggctgtaggaaaatggaaaggaagttaagaaaaaggaatggaggtggttaaaattatgcaaaatagttcatctgcagaaaa

SEQ ID NO: 9421 - DNA, 1087 bp, artificial
  synthetic oligonucleotide
ccaatgccaatttcccaacatggcagtaatctgcattgtcagtccctctgttctctgtcagcattatcatttctctcctgcaaggcctatgttttaacgaaaagtatgccccctcaaaaaaagattgaacatctcccaaattgaatatcagttaaaagcaagcctatttttaatattaatattcattttgtactgtgaaattgtcataacatgttatgtcctctcataaatgttgaaacaggtccatgattcagtaccattaaatcacttgtaaattaccactgatgagactaaaattgctacttctaaaaacgcactgctgtgagggcttcctgtagcttggtgaattaccacctcaaaactgccttacacgttgtcctgtctgctcagacatgatgaatgcttgatggccactgtcctggagctccaaatggcaagcccaggcttccagcccggcatggatataattatctctacttttgattttgcctgtagaaggtagagtagaatgtccaaaaagtgtaattatataatgtgactctcattactcaaaaataaaataaaaaaccacctatttggcattgttacttagaggcaagtagtatagaagcactgttggtcagtggttatgttgagttttgttgcccattttaaggtgttgtgtttatctcatgtgatttttcaaaatttcctacagtaggcagagcaaattaagcaaataaaggagagaattacgcctcagcaactgtccaaagagtacgatgttctgcttcttgaaaagcagatatatttttaaagcaaagtagctacaggaggtcagtcttaatactggaatggttagagaaaaaaaatgagggaatggcaaggttgctcctttagttttagattttttgttgtttatatttgtttacttttgaagtgaataatttacttaaggtatttaataggaaaaaaattatgtcttcttaaaaccagcacaatctttcctggtaattctgaggaagtatttctggattccattggtgggagtaaaatggtggcaataaggtcatcgtttttttcattagcgtatcatccctcagtatca

SEQ ID NO: 9422 - DNA, 2451 bp, artificial
  synthetic oligonucleotide
ttggttatgctgccaaagtaaatgtgggacgcagatgtttttgctttttgtggaaaaaaacacaaagatactaattgaacccatttaccattcatattttgacctcctggataagtgtgtcccagccacatggtgagttagccttctttgaaaaacttcaacttgcatatcatttgcgtcatttctctactttctgaatcagcctaatactcattttgacacttctaacttatcttgaaagtccccgttttttcatgttctaattttctgtccacctgatggttttcggttccttcaggtcttgacagcatagtatagaacacatcctaactcactgtatgttgttctgcccatcccctgatttcagagagatgtagggttttcattctcctgtagggagacataggggttattcatgaagcagagaaagaaaaaaaaaaatagaatatggggaaataagcagatctctttccaaaagctgaggttttctaaggaatatggaaaataagaggttcctaaaggaaaatttcttgcctgaccaaaaacataattatttctttcattaatttaggtggatgtgtgtttatgttgacaatagagaataaagggggtggtaagctctatgcaaagagggctgtaaagaacagctgtcaagacattttcttatgagaatgagaagagaactacctttgcaacttcaaaaatggagacatggtatttgtactttttcttttgctactagacagtgaagttcttgggacctaagggcagggttttatcttgttcctctctttctccacatcttagtccattttgtgttgttataacaaaataccagaattgcctagaatactgggtaatttataaacaagagaaatatattggctcacagttctggagttggggagtccaagagcatgacactgacatctggtgagggtcctcttgctgtatcattgcattatgggaggcagaagagcaatagagtgcaagagagcaagaaggggccaaacttgcttttataacaagcctactctcaagataactaacccactcccatgataaggacattaatctattcatgaccaaatcacctctcattaggcaccaccttccgacactgttgcattggggattaagtttccaacacatgaactttggggaacacatttaaaccttagcactgcagtacatatttcacttattctacaagcaaccatcctgacctgagtttgacttgggaaagttattacaacaaagttcctgttcttgatcctttgggagctctctcattatccctgtcttagaacttggtttagctggctccagggctttcatgatggatgaggtgtggattggttagttcctcttgcaatggccactgcattagttatcataaaatttcatgtagagcagtgtttctcaaagagtggtccatggttgggcatcaacagcatcacctgggaatttgatagaaatgaaaaactgtaggtccctctacagatttactgaatcagaaaatatgttttaacaagccctccaggtgattgtaatgtgtgctaacgtttgagaatgctgacgtagagcattctgtgctacattggtagtatctcatgcttcacttgaggggctttaaaaataaataaaaatggaaattgtggaagaactccacctgacaaaagttcaaatagtagaattagagaaaagatgtgcaaaaacagatttgggaataataatcagatcatttgttgaatgcctgtcacgtataagacactcttctagcaccttttgcttacattctctctattcctgacaacaaatgtaaaaggtcggtagttatatatccatttatatccctattttatagcagatgcaacttattcaaaagaggttaagtaatgcattcacggtcaacagctaataagaggcagcagtgaaatggaagttgaagcaaagtctgtgcacttatagcaactagacaggaataaatatgaattttgagctgttggtaagtggggtattgttattatgtacttttttattatgaaaaatgtttcatggctgacatggcatttctactctgttttaaaagattttggcaacagccatgagccagttcaacaatgtatgtcagatttgtttaaaggattttcaaactgtagcacaaagaccaagcctgtgcaggtctcacatgttcttgtgtttgataacatctattgtttacaaaatgagagatgctttatcacaagggttgttcaatggattgggcttcttactgctaatgtgacttgggtctgtgaactcaaagatgagagttgagagcaagagagagagaaattgtaaactcttattctcagggactgggtagaaaagggagaggctatctagaccactgacttttaatcttgtttgatcaaaacccacagttagaaatacattgtataatacatt

SEQ ID NO: 9423 - DNA, 1318 bp, artificial
  synthetic oligonucleotide
tctgatagttctagctattagaattgccaaatggtaaatgtcataattcttctaatagttgttctagtagttctaactagattttgatgctcatttaggaggttgggtagcatctcctctccagtttcatttgcatgtatctgcgaataattcagaaagactgcagcccctacagaacaacctcctcttcactgtgctgttgaaagcccagctggaggcaactgtaaacttacaatcgccagcccttgcaggacatctcttagggaaactacagagcataatttggaagtccatgaagtgctacatggctttgtctaaaatctcatggggagaaattgaatggccttaaactgatgcccaaattgcatatttaaaaaaccctctaatttggaggaagtctccccaggaggctgtctctgctgcttggcctataaaactctaaatattacaattaaaaataacaaagtacacaactggaaaataacatctattgaaatcataatttattcatttgtttgttttttttcccccttctctctccttcaaataatacctccacgacaaaaggatcctctagtatcacactcactccccctcattcctgtgggagactcccaggatgcaaaatgataggcagctggggcagggcattttgccactgccttctgcattatttagaggcaataaggagcaaactgagaagctggggaaagaagaaaagagtctttggcaagacacattggagtatttctttttaagaattgagtgtttgggaataaatgaatggtgtagtagcaaagtatagaacaaggtctctcaattctgtcaacttccaggtactaaggctgtcacaatgataatgacatgccttttaactattgagcccctccctccaagaagttccacctaaggagattattttaatggaaccatggttcttgaaactgaccactagggagcaattctcatcgatatagtttagcaacacatagctctttagtgactttagccacaagaatttggggagttgggatgtttccaagcacagtgtaatgagctcctttcagagaggcacagctttctagagcagaacttcccaatcactgtgctacaaatggatagaggcagggtaaccatatgtcaccgtttgctggggcagtcttggtttatatctgtagtcccagcaaaattattaatagtgcctcctttcactagaaccattgtcctagtttggatgataaatatgaatgataaaatatatggttggttatatgtgtgccaagatttttatctccctagtcttcagggtggctagagt

SEQ ID NO: 9424 - DNA, 1413 bp, artificial
  synthetic oligonucleotide
tgtatttctaatctgttttttttccaactgccacctcatgctccatggtgtgctgcaaacttggtttctgagagataaccactttgcaccagtaacttgcagttctgcttttgctccttttattatggagtcataaaagcgtaatgaaagaaagagctcctagctgtgagtagcagctaaaatgccaatttcaggtctgtcaaaattgatcctgcccacagtcctctaaaatgctcttacttttaaccctgctgaaagaaaaatctcttttcttaacccccaactcttcctaaggctatttagcttctaattttgctgacgcggttacttccaccaagtaccacttaaatattaaagtataagtagttgccgttccttccttattacctttatcagaccctcttcatcttatcacggacttaaagaaatggtttttgaattgtcctctctgtcctcattgtctcttctagacttagagttcttttagacttagagatatgtaaaaatcatgtattactcgtgaccatatgtaaaaacggatatataagcaaaatagaattgttaaggtattcctaaaacttcatcgcattcagaaccccttctgagtgcctttttgactcagaatcactgatgtccacttttgttcacatagcagttgttcatacaactgttcaaacaactgtgccatcaaaaacattggtgatgcagcattcttaggagctctaggagttcccactattgtctctgagattttcttccaaactcccaacacccactcttcaagttttgactctgggacttttcttgcttagcctgagataagccacgcttttgtaagtatcttagtagcacatggctactattttcctgtcttaggtcccgaaagcatttgtccctttgctagcagatatgaaaatgtgttcacttcttcagcaatgaatatttgctttgctgatatgcaattcacaccccactgctctgtttccacgcttttctgtgtaccagtaactttccatttcaatattgaatcatgatgtaatcttttggaagacaatttaaatgggatttaagctaagcatttgtagtatcagcactagacgtaattcagttgaggtgaggaccatataaatagcaatgagtacattgttcacacttgtgcaggacaaactgttgctttgtgcagagcaatttaaaacaccattgattataagacatcctgttgttaaagatgctaaagcgtgggaaatgtgcatcttgtaaaagacgaatgcagaggtaggtactcaggatgcaatatggtggctccatagtccatccgagacctgagctatttctgccctctgttattgcatccttagcacatggcttccatcgtcagtgtcactgcatggtccaagatgacctagtaagctc

SEQ ID NO: 9425 - DNA, 1384 bp, artificial
  synthetic oligonucleotide
atttcctgtctctatagtcaatttaatgtcagccacgggcagcttcccagtgtttgacattcgctaactttcagaagctgccggaaacgtgtcagccttactctggtctttcccaaccttggctgaacaaaagcatcgcctgagaatcttaaaaatcctgatacccaggtcacattccagaccagttacatcagaatctcagcaatgaggccaggtatgggtatttttaatgctttccacgttagttccagtgaatgcctgggatgagagctgtagcctagccttacaggccctctaaagccttggctgaagcagtgatgctggctcctcccaggacctgctggaatgttcctccttgtgttctgttctacttttcaccatccctactagcagtatttcctcgtcttccaaaatagcagggtctgattcctggtaatggtgctgagaccaggcgtgctgggttctctgagcagagtgtgtcgaggctattgccttttgctatacaggttctgtacattgggcctccaggttaattgggtttctagaaggatcctaggaagatgacatgtctttttcctttttgtcacatgctgacagagctggcctccctttcaactgggtttgaggtatttcctcagaggagagtgagctctgagttgtagaagtgtctgggtgtgattcaatccaagcaacaatcctgaggtactgcagggccgaacaccatctttctgggactgggtcctcaggacaagcaaggagttgatggaccaaaccctggtttctagtgccacaatggagccgagaagtcctttagaactttgggggacagcaccactgacttctctcctcttgccgcctcaccagttacaggatagtttccttgtattttggtcttcatcaggtacaaagtttaaaaaccttgtatagcttagcccttgatttgtaaagtcaagtgcataatcacaatatgcacaacctaatgttttcacaaggcaggttgatcacccagtttgctctgtgtgttctctcgattgaagttctaaccgacttcttagtggaaaggaaataattcattctgcagagagaatattacatttcgcatgctttaacctgggtgtttaaaaattcaaattctcctatgacattgcactcccttttttgcattttaattattctggagctgtaaagagagttcaggcactaagtaataatcagatgctgaatgcctaaactctacagagtggttgcttttaaaaacctcaatcccagataataaatagtgggagtttatcaaggcaagtggcatatacttttcctgtgttttgattcagatgtgtaacaatttctacctgctggtttaaattggcccagagaacaccttttg

SEQ ID NO: 9426 - DNA, 1434 bp, artificial
  synthetic oligonucleotide
caaattccaattatgaacaagtctgagtcactattggttaacagtcttctgagatgttaagagtagtcatgcaggccaactgatacaaattccttcttatcttcccacaaacttaacaggtactaaaatctcatcatgctctgggtaattcctgacatttccttactagttacaaactaattgattgccaaactctgagtccatgctacatgttcctccatagagacggcaaccaaatctttgggaaactatttcaagaaatgagtgtatttgacaattatttggtgttcaaacaatgtagttttctgagagttatgcttctgctttatggtttatttattttctagtcacttgggagaaactcagagacatctgtagcttcttgtattctatggcttttttttgctaaaatctcaagccatgaaaagaaaaaaaaaaaaaaaaacggtaagtattttgaaccctgcagacctaaaggaagctctgaggctttggaaaatgatcacagaagtcacccaattttgttctcattttgtcagctcacagtcattagagaagatgaaatttctctgaaaaaacaatgagtcaatgcagtgtaattgttgagtttaatggccttatcttacaaaataatgcaaactggttatttcttgaactatgtcagactgtgcaatcctgacattgcacttttctgaatctagcatttaaggtacatttcaaagaatacttctgtttggttaagagatggcttttacaaatagccagaacaatgaaatttcagttggaatattaaggaaacctctgtaggactgcataagcaataaaattgtcaaggggaataatgggtttgccaactctggaaaggttccaggctcaacttgacatcacctctctgtgataatttagaaaccacaggagcaggcttgctttaatgcagaagagcaggtggatgagccactgggctttgctgggaatgccagtcctgtctttccattccctaagatttgattggttagctttttctgctcacagggaaaaagttagatgcaacttgctagatgcagtttgaacccagtgattttcaaatattttgagaaaatgacacgtttttgcattattttttgtgtattttggtctttggatatatatttgaatatatatttcagagtatattagggcttctgtaacaaactgggaggcttaaaacaacagaaagatattctctcacagttctggaggtcagaggtcccaaaccaaggtgttctcatgattatgctccttctgaaggctctagggaagcatctttccttgtctctagtagctccaggcatttcttggcttatggcagcatcactccaatctctgcctgtgtcttcacatggtctcctgtgtgtttcttctttttggcctactataccttatcctctttttctc

SEQ ID NO: 9427 - DNA, 1765 bp, artificial
  synthetic oligonucleotide
ctttctctcagccaccagaccctcctccactttttaaaatcttttgatattaaattagacctcttatctgtctccccactcgcatccccatttgcagtccttgtcaaaaccaacccgttttctttattattcaccatcattaggaagtcagagaggatgaattttaatgctttgaccctgtcaggaaaatgttgattttataatactaattattaaaatagtactgagccccattcaataaatcatatacagcagattcctaaccaaagagcatttatctttttgtactttagtgagatttcattgacctttgcagacgagttgtgttgactttctttggagtctgttcctggcttttcgttgttgtttttgcagccttcagtagatggcaagtgctgaattccaagtgtatggagatctcccgtggtccaccatagtggggaggggggataaatctaactctgaaattctcctttacccatccttgcacccccatctaagcacacacaaagcaggaaaaaaatcgtaatcaaactccttcaagctttttgtttgtttgttcaaagataaaagttaaacctggtaaaaaatgagtacaagaaattccaggcctcatcccaatcaggcattcagtgggtagatggataatggatggaaagatggatggattgatggatgaatgaatgaatggatggatggatggatgaacagacagacaaatgaaaggatggatggatggatggatggatggatggatggatggatggatggatagacggatgaatgagtagatgggtgggtgggtggatggatggatggatagatggctgagtggatggatgggtgggtgcgtagactgtgtaaaaggaggcagtccccttcctcctgtaatgtgtgatggtgagagagatgggtgagtgctcacagcctggttatggatgtgtgtgaccttgcctttcagatctattttagcatcagtttaagaagacacttccttttcttctagcaattgcacctctaaccctttttctagcaaattcagaaaggctgagtagctttcccaatagcccaggtggtactgggcttctacccagagaaacatggatagaactgtcaaccagggctaatgatggtgagcgcttggagaattggggaacctttgcaattcctcatgttgctgattgttattacccattgccaattccccaatggatcagtctatattttgtgatatgaacacatgatttgtggatactgggagactgggagggatggtagcaaatctaatttgtcactaattgagccaatgtagttcagtcctgttaattctgtactttattgaactctaaatctattcacatctcataaaacatgattaatctctctagctctttaaaatacaacaatatatggcgtgcttaaggcttaggaatttgacaaagagcccaagaataactttttctctgaattcatgaaaagcattggttaagctactttatgaacaagaaatctgtcatgaaaaagaaaagaaatcttctttacaaacagtaaagcttaagagaaatactcttaggatttcagatgtaattttgcctttgaaataccttttgtatgagaattttaaaatctctagttttttttttttttaagtatattggaagggtaaatactaaataaagattaatgtaattgtcttaaactacccaaaagtttgaagccagttgtagaaaaaaacaaactagtaagcaaagatatggtatgttgt

SEQ ID NO: 9428 - DNA, 1605 bp, artificial
  synthetic oligonucleotide
taagacagtgaaaattggaaaaaggcactgctttgggtggatgaattatataatggcacctcttattctgatgcagacctttctagagtacacattgttactatctccctcaggtatcctaatgcaggctacagaattcagaatcggaaacaatagccatgaaatctagagtcaggttgctgccctccaccctaggcacagccacttagaagctgtgtgatcttcaggagggaacctcatccctgaaagccggtatagggcttatacagttcaggtattagaaaggactcactagataccacagagtgtactgtaggtgccaagggagagctttccatttggccctctgaaggtttgctgaaaaatcaacttgcaaaaggcagattaattggagaaaaggcatactaatttacttaatgtgtacacatggaagccttcagaacaaagacccagagatactgaggaaattgtccatttttgtgcttagattcaacaaaggatggacaggaatatagaaacatggttggacaaatagagtatgatctagtgctaatggactgagtggggaaatccaggaaggcctttctgtctagattcttcttggcatctctaagcagccttccttccttctgggtgtggggcagaaccctctctggaatggggggccttaggacctgcagccaaacaaggtaggtcagagaatttctttatggccagtttccacacaaaaaagcagaggaaaagttataatagtattttcaggttttatggctggctctgtggcaaaggggctctggtttgtatggcatgccttggggaagagggatgctagtttgtatgactagcctcaggggaaaatgggactgagagacaagagagcagcagcaggtcagagaaaaaccttttcttctgaggccctcagtttggggtattgctttctgaacccccaacaatacgcatgtgaagcttttgtttaaggagaaaaaggatatggtgcagtaagagaaagtaaatgtgggcaacatcaggagtcagagagactttccaacaacccagagccctttcttcgtttcagcacatagggccaggctgagtcattggcttgaacatcaggatctgtgtgcccaatcttggcttggggagagttcagagaagctttcaatgcaagggtgctcctgaatctctttcgttataatcaagctaggcaaaccagttaaggcagtgcaaacctgcagtaaagtaacttattaggtgggttgccaggacagtttctaaccaaaaaaaaaaaaaaaaacaacaacaacaacttaaatctcactgcccctatcttggccaacagtcaaaaagcagacctccggcactttcagagataaagaaagctttttccaccccagctgtgaatcagttctatctacacagccttattttccttatttgtaaaatgaggataattatacacctttttacaggattctgtggggtttatatgaggtgattcatgcagaatacttaacacaagtacctggaacttagtaaatattcaaaaaatcttctgttactaattaaataaagagtactcaacaaggagtcagcagccagatttga

SEQ ID NO: 9429 - DNA, 1301 bp, artificial
  synthetic oligonucleotide
gaatctctgccttctctatcctggtcaggaaacaaatctgtgacccaggactatactatctctagcttccaaggccatttgctattgaaacatccttgtacaaagctatcagtactcttcactcagagaacatgcagaaacatctgaattatctcccaacaaggaaataagtgatgtgatacaaggtaattgaaggatgtcaggggaatgagaagctgaccccagagtggatatatggagaggggcaactggtcctaggaagaactgggaaagggtgtttccagaggcaacaacatgaggtggatgatgtgcttggtgtgttcaagggatgccaagaagagcagcatggcaggagctgcatgggcaagcagaaaggtagctggggcaaatttgggagggtacaggagccaggtcattcagggccttgtaggtcgtagtttgagttgggagttcatcagaagagtgatgggaaacctgtgctgctctgtaaggcatgagtgacctgtattttcaaattacagctccaaaccatgtagtgggtaagtcagtcaattttgctggtcatacgtagcatttcatttttaaataatgagatagaataagacagaagatatcagtgccttttatgtagtggaatgccttatataaatattgtttcatgaaactttcatttattatcaaatttcaatattaacttttattaattaacattagttatatattatataattaattagaattgatgttaattaatattgacatttttcccatgttgacatctcttctaaagtcaagatgggtctcacaatcaatagtatctaaagtttgatgaactatgctatgaacgttttatatgtgcatgtgtgaagtgtattgctatgtggtatttatttctgagtatgggtcacagtcactattttaccttcaaaggcctagttatggtagcaaggttggggcagcctggggaaagtggaataccacctagaattggatgcccccattctgggtggggtaattgagagaagatataagtagccttgggctctggaagcaaatagagttgtttcactggccaactataccagacaagtgtgatcaagccatcagagtcagacattgacaatcagatgtaatggggctggaagaataccctgtgaacagagggaatccaggatctgacaaggcttttgggctcttcatagcagcatgcctgattggttaaaccagcaggagtgaagcctcagcctttagtggcatatggtgccaggatggttactaagatgaggtctttggcataaaga

SEQ ID NO: 9430 - DNA, 693 bp, artificial
  synthetic oligonucleotide
tgtttgttgggttttttttttcctttttcctctctctagaaagggaggatcaccaggaagaaataagtccagattccccatcagttcagtggtatggagtccagagtcagaatataattttttaatagaaaatgtgttgtaatatttcttgaaaaacaaaatagattggacaggggcaaaagtggctgtagttagccattttgtaggctacttcagtgattttgacattggagggagggaggttgaatatgtagagaaacaattaagtgttagaatttataggatttgttgattaatgacatgtgaggagttaaggctagccagaatgcaggaagagcacctgagtggatgttgtttccttttagcaagataagcaacagacagacttgggaataagaccattagtctagtcctgaggctggtggttacaaaatgtatgtgagagatccaggtgaagacgtcaagtggacaattgaatatattggtataacctggtaggcagctgaaacagcttgctttgggattcaaagaaattatgttgaaccctgatcaaccctaatcaacatgaagagggcctacagccctcctagtctctagagattcttgatggcagggctggtggcagaaaggcaggcatgtattaacagttttctgctcatctcagtcaaaatttctgctttcattgaatttgtt

SEQ ID NO: 9431 - DNA, 2191 bp, artificial
  synthetic oligonucleotide
ctaatctataacattctataatggatttctgcataacacaaagcatttagaacaaaaattgccaaactatttaacatttaacaaatgcatttgtgggcttgggtgcagtatataatgctactgtgcaatgttaagtgcaaattacatcttcctcctctactgcaacaaacacactactgccaataaacattggattgacctgtatgcaaagtatatagagacctgaaaatgactcagttatctcttccttgtgtttacctgtttctttttttctttctcgagacagaatgttgctctgtcatccaggctgtaatgcagtaccacagtcatagttcactatagccttgatctcctgggctcaagccatcctccttcctcagcctcctgaatagctaggaatacaggcccatgccaccatgcccagctaatttttaaaaattttttgtaggcacaggatcttgctatgtttcccaggttggtttcagactcctgggctcaagcaatcctccttccttggcctcccaaagtgttagaattataggcatgagccaccacacctggccccagctaattaaaaaaaatcttttgtagaaatgggatctctctatgttacccaggatgatttcaaacttcagggctctagtgatcctccagccttggtctctcagagtgttgggattacaggtgtgagccactggacctggcctgttcacctgtttctgtatgcttcgtcattcccacctcgtgttttaacatgagattttatagctttcctatctttcctactttgttcatggaattttccatcttcttaaagggcattttcaattgataatatggaaaagactatcatgcttatgcacaagatatttaaacaactcaagcacaggatgtgttccaatccaataactgcagtgcaatccacatcctctcttctagcctgaagagcacattgaacattttcactggcatacatgtgcaaattaatcatggcaggttttcattttagttagcgaattgagtgtacaaatgtcttatatgttgttatagcagatatttggaaggtgagagtaaagtttcggggcatctctataagattgcttttattcacaaaactgaagatgctcttgtcattatatagcatactaaaggttctaggtggaggaaacaaacctagtttttttttttccatggaagtttttgtctatgacatgtgggaaggtgaagcatgataagcatttattccaggcactgtgcagcatcctgggcccacattcctcacactggagcagaaacagttgtccatctaaagggcttttttttttttttttttttttttttttttttttgaggcaaagcccagttctgtcgcccaggctggactagagtacagaagtgagatcttgacctcctgggctcaagcgattctcccacctcagcttcctgagtagctgggactacaggcatacaccatgttgcccagctaattttttaattttttgtagagatggtatcttgctatattgcccagtctggtcttgaactcctgggctcaaatgatcctgttaagttgccctaccagagtgatgggattacaagtgtgagccactgcacctggcgtttttgttttgttttgttttgttttgttttgttttttattttttttaaatgaagctgcatttcttcttccaaagaggaggtatgcccagaaactgcatgagattgggtgggctggctatcagttggagtccagcccagcctagaggattctgcctttggctcagctaaatttctcttgttcactcccctctagttgggatgaagttacttccacctcccctcagggctggaagagacaaacatatgccccttcagacttggtcactctaagcacttagtggatggggagatggtttttcttttttccacatgggatctcccttctcttgaggcagtagaagaaatgttattttttccagttaaggaagaggttcactgtggactgctaagttgactggcgccctagttctgctttattggagagatttcagtcaaagccccttttgtattgctacacatattgttgccaggccagggagggagtgaggtatgagtggtggttgaaatccagaaatagtgtagcctgtaaagtctaaaatatttactaaaaaattggctctttggaggaaaa

SEQ ID NO: 9432 - DNA, 1944 bp, artificial
  synthetic oligonucleotide
taaaaaatgacaatgagatttctgccaatgcattcttttccacatgagccaaagagtgcaccagtattacacatttactccagtaagtgctcatgtaaaaactaagttcattaaaaagaaaatgtggtacatatacacagtggagcactatacagccataaaaaagaatgagatcctgtcatttgcaaaaacatggatggaactggaggtcatcatgctacgtgaaataagccagacacagaaacacaaacattgcatgttctcatttatttgtgggatctaaaaatcaaaacattgaactcgtggagatagagagtagaaggatggttaccagaggctgcagaggctgggaagggtagtggggggtgatgtaggggcgacgtagggatggttaatgggtacaaaaaatagttagaaggaatgaataagacctagtattttatagcatgacaggatggctatagtcaataataatttaattgtacatttaaaaataactaaaagagtaaaattggactgtttgtaacacaaaggataaaagcttaaagggagggatactccattttctatgatgtgatttttatggactgcatgcctgtatcaaaacatctcatgcacaccataagtatagatacctactgtgtaccacaaaaattaaaaagaaaaaagtgaagtttatttagttaataaactaataaggtctccattatataagactagttcataaccaaatatacgtgaagaaaaacacaactcctcagctccgactttaaaaggattcattcacgtcttaaaataaatagtgtgcatgttcaccatggaagtggttattgaccacgggtgaacaaatgactcacttggggagattctatagactatagatgcctcaccccgcacccacagaatcagaatcctggggagggtgttatagcatgggtacaaagataacacctcccaagtgaatatcattaagaattactggagcaaaatgagacctagaaacttctcttccactattagacttaatgtcagggctaactcttccaagggtccctctacgacccaaatcactcattttcccccactcctatctttctctttccattgccttactcccacaattgctggaatgggaaacacctcaaagggaaaaaactgttcatggagtcatttttgaaatgtcagtgcaaatgtaagcaattttggcctcacataagtaacaaaggaaaaaatggagtgctaatagtggtgatggtttaaggaatccaatttattcccaggggctccattcatcaaatatcattgtaactttattgcatattcaccggaaatcattacattttggtagtttgtgaattccactacttggggtcataaaattccctctattataagaaatcactgctgtcaagtccagtctgattaaagtgaaggacagatgatctgcagtcttgtagatgatgtttttggctgccaattacttacatatgaaagacaattaagtgattataaaaggaaatccataggtacagttacacatcataaataattttaaagatgggtaatctgctttcatgtcttttattgtttgcatgcagttccttgaattgcctccactccaaggcatttcaactctattttttgcacaataactttaaaaaaatctcactggctatgcacaacaccatgaccataaaactcatgtgtcagatgcctccctgctaataagctagaatactcacctgtcgtgaagtgcagcatacttatcaaacaaagaaacagtgaaggttaattctttctactgtctgacctttgtagtatatgggagttgctgaaatattttgtttcaaataatgtttaaataaaataagtaatgcttaaataattattattaaataaataattatttaattgctttttaagcataattatttaattgttttt

SEQ ID NO: 9433 - DNA, 1470 bp, artificial
  synthetic oligonucleotide
ttggagttgagtttaatctaactttcctatgatttgactgagagcattataatgagaaatcatagactacctttagttctttacagcaaaaacatatatcaaaagtatgctgccttgcttctgagtaatttaggtcattatgtacttaagctctgaaaattatcttgaagaaatctaagccttagttttagataacaaagttaacattcccatttttttttttttcctggcaaagagatgagaagggttttctgccagaactgttctttcagaaatatattttcaagtatggtttacagaatttggcataagataaatagtctatactaaataattagtgagtgaagtcatatacaattcattctaacatttgttgcaaacaaattgtcatatttgtttagctgaacaattaccatgtcagtacttctttattgaatataacggaatacaatgtacatgttaaaagtaaatagcctgctcttggacttggtctcagagaataaacttttatttctgtttttacatttgaagtatatatatattatatatataaaatataatatatatatttggtgattgatggttaaaaagtcatcaacttgtatttccaaggagtctctgttttactgctttaagctcaataagcaaagttatgatgatattgaaatgggtttttatagatgtcagtaagtttttattttagaaagtcttttttgaaagctaggaaaacacaatcatttctatgaaagaaatgtttccaaagtttgaaaatgaaaagtaatttccctgcaattacaatttactatagggttttaatttttattttggttattttttataggcttcacaagttttatgagatttgcttaattgaaaataagaacatgattacctgacaaagatgaggttcaaagaaagcagtaggcaaaagttcataaaattaatggtaaaattttcctaatgaatgtaggaatgagtgtatttttctattgaactggcacagttatttatctggtcagagactggtgtgggggagaacacgcggccatctggctgattcaaggctgttgtattgattcaacattggataacatactgaccatggtgattttacaatggttcctgtaactggagtcctggatatttgtctcttttgaagttcacgatccaagtcaccggtctttaccctagtacaggagcagttagcagtctcagctatacagtggtggagtctggaattagttttggtgtaaatcccaaacatgcccaactgaattgtggctcagggcgatgtcctgcttcatggcctagggccagggctggcaaacttaacccatctgatgtgtttacttattttagaaagctttatgaccatttttataaataaagttttatttaaacacagccatgcccttttgtttgtatactgtggctgctcttgggagagttggatagctgtgacagaaacca

SEQ ID NO: 9434 - DNA, 6002 bp, artificial
  synthetic oligonucleotide
atgcagatatcccaggaaagagcattccaggctgagggaacaaccattgcaaagagcctaaggtgggaagattacctgtagagtttgaaggatagcaagaagtccagaattgctggagcccagtgagtgtatgtgtgtgagagaggaggggctcggggtaggggatgaggagggacagagaaaaacgggagagggaagtgggcagtaatagttgaggtaagaaagatcaaaggatacgggatctagggtcctgttggcccttgcaggagcgcaactttagcttgacggacaatggggagcttttacatattttagatcagacaagtagccttatgtgatctacgttaaaacacacacacacacacacacacacacacacacacatacacacacacaaaacatctttttgtctggtatgttgagaatagattatggcataaaaataaaagatttctaaatatattgccttatatgaaaaggttgcgatgagactccaatgcaaaaaaaagctttaaaaattataaagcacagtgcagacccaaactataattattttacaaacaatagagttcaaaagccaaggtccctctcgccccttccgatccttgagtagtaactgcgttcatgcaattaaactagcctgtttaatagaagctgcaggaaaactgataactatgtattcaaaaacatgtaattttatgcctgagttttaagtcatttagattttgcagattgctatttattttatgttcagtttttgaaataaatgcttaaaaaaaacgctttagtactaggcttgaatactgaagactttaaatataacaacagaccaggagaggagcagaagtgtgggaactttaaacctatttctttcttaatcccctcggagagctagactggaacactggctggatcttccaacatttctgggggtgctctctgttctttgcggtggccctgccgccaggtgaacgctgccggtgggagagcacacacttagtgcggccagctgaccttcacagtctggggggaaattttaaaggattgtggagaagaggccttgagacttcaagaggaagaagaaaaaggggcccaatgaagcctgagcctcccaggaggtagaactgagttaatgaacagggctgattatccaaggtaattatgtaaaagagaaggctaggaggagttctagatggctgcaacttggagtttactctgcctaaggtgagtgtttatgtttctgtgtttttgcttctccggcaaggttttgttttgttttgtttttttcttccctgttcccttcacccaaggctcagtgtgcaaaagcagctcgctctgcgtggcagaccccattctaatccttctctttccttagattctgagcccggttagaattagcctccgcatcacgggctcctgggaccctccgctctatgctcctcgaggagggagcagctgtgttcatccccctacccgcaaatgcctccggttcttatttggcagacactcccgcggtgctgctgtccaaagacacaccttcccagccagcccagtggtcacgtctcgccccagcgattcgggagaagcagtgggaactctgagctccccgaatcgagcccgctgcgcctggcatctcccttcccttccccttgacaaacgacccaacctcaatcatccctgctccttccgaacgctagttttgtttacggagcaaaccgaggctttgagcaacctgcggttgcacggctctccttcggcttggggagggaggggtagcgttcacagttctccagtgtgccatagactgttagaccagatccttcagatctagaggcacacgcagtgggtgacaggagagtgccccctccccccgggcgggtgggggtggggagaggagcagggactcggcttggagaaggaggcagggaggcagctgcagtgctgcgaggggtgcgtgcgcgtgtgcccagctcgcctgccgtctcccggctccgtctgcgctcctcggtgcgtggggcacgagggtccgagggccgggaagccagagcagcgcctctcgcccaggcctcgctttctctggacgcccggcagtccccggggctagagcgcacggggcggggcgcgagacccgggccgcgctccccgcccccgcctcttgcgccctgcctggctccctctccattgagttttcctgcctcgggtgcctatcaatggtcctgctcggggatgcacacgcagctcgcggccggaggggggtagcagccgccgcctccaggtgcaggttctctccggccgccgccgccacccgctgtcgccgcgactcgagccccgggcgcactgaggtcttggccatggggctgcggaggctgctgttgctggcgtgagaaggggcgacggagttgtcgcgctcgggggtccccagctgcctgcatggatgtcttcagctttgtgaagattgcaaagctttcgaggtaggggctgcgcgggttccgtttgcacccagggccgctgccgcgggcaacttggtgccttatttttcgggaggctgggtagaggcaaaagctggaaagcgcgacggggcttaagacaaacgaagtggccgggggcttccacgttcaacttatttctcactggctgctgaggcttgtgtagcggcgggtgtagaccacacacagagaggtacatacatgccctcaccaacacaccgacattcacgacagtttgttttccctaaggaaaagccccagcggtgtttggggtcccatgtataattcagggctaagagaagatggttgtaattgctactgctagggaaacccagaagtgcttggagcttgggtgcctgccttccaagctgcaaagaccaaaagtgccgccttcccccaactcctaaattacacctccacacctccacaaagtcagctcctagattgaccaggtgctcccaacggtaacctagatggcgaagtcatgtagatagaagagaaagactttcagcctttttttttttggggggggggtaactatattcttaagcctcgaaagatttagaaattttcttctaagtggccatgttgttaaaacagtagctaaaactaaatcatcgattcagacatttttgggtagtactgataaaagaggaacatttccacgcttgggccgcctaggtgttgcctggccagagcactcctccaggtcttctgccctgcttatgcttccaaagtcttcgtttgagccacagagtaaggtttgtgctgcttgctatgtggcattaattgggaagagcccaataggagtggtcttagaaaaccatgcccaaccttctctgcccctggagctctttatagcagctaccaccaggacgtaggaggtagacagttgggtttttccaggatgtagcttaaaaacttacttgcaatatggacagaataatcccaggttttccttcagtcctgagtgtcagagtgagatgtgttgattgcatcaggcagggatgagcagcttccaatagtcagaggtagaaacgtatgttgactttgctttattaaattacattagaccacttcagaaaggttctgtttggatgttgccattctctccgacatctacaggtctttgttctgcctgcccatctccaccttccctttctactaacatgggtcagtcttcatgccactagcagatttccccaggcagaaaggcccagtgcagcttactctaagtagactggagatacgcagttgatgggtaaatacctgtgtcttagagcagctcaggaagaggtgttgtcctgcagatcagaagactgatgtgttaagcagtggatgattgtggtgtggccaattgtttgctttcaagctgatctcatagagggccattgcttcacaccactattctattaacttcctgcatgcttctgcctagggctagtttctaaacagctgtcaaatattgaaccatggttgggaagcagctgtgtgcaagtttagaggctaagtggtaccctccgtgtgatggacagagatactgctaaagggaaagggaagttcaaccaatagtatagttcaaagtaaccaggatactttttggtggcctcagatgctaaaaacagtttaacaaaacatctagagcctcgatttagtccttaaacttaggaactttggagaggacagtgtcatgtgtcagtgaaaagatgtttcatattctttttactaaattctaggatgcctacatgatattcacaaatctgagtttttgcaaaactcaagcaaggctgtggggagagtggtatcttattttaaagagagtttaaaatttagtaaatgagtgtgagtttcactttctatccttaatgtgatccagtagagtgtttattctaaagacagaaggtgcaaatgttctgagctgatgtgccgattaagaaatcttccatccatagaattcttctttttctttagtgtgagcccgaggatggtccccgtgctgagatagaagtacctttagagggtcatcagcatgtaaaaacacatgtttgcagttgcttgtttctgccttgggaggaagaaagtcttgtatgtgttttaaacactgttacagaaagcaagttcttttctcaaaggtgaagtatgaaagtgcttatactgcaggattttcctgatttcagaatggataatcttcctaaaggatttagctttgatcagcatggttacttcagtgcttaaaattctcttggtttagaggcaaacacatgtagttaccctgggtacctggccttacctttggttcctacaaacttgagcttctaaatgttaattcagaaggcatatcttggaagtgatatttgcttagtgtcctatctgtgagtaaagacagtgtaattacagagaattccaagagaatattattcgacactggaataaataaactgcatattttgactttttagagtgtctacatttaactattcgtttccagaatctatacccttttaatcgtgggaaaaatcagaattgacagtgcccctcaataacccagtaccattaaaaaaaaattgctgccaagtgttggaattgctggtaagtagttggcaccctttacatcatcagttagagttatgacccttgattgcatccttcgtgggtggcacagtgtgtcatggttctatctgaagatggtttttcccgttcttctaattttctggttcttaaactgcttgatagtttacatgcagttttacttcactgtttccttggtaacagttctatattattttccatccttgtagatgagagcattacagatgattgccttataaaccagtaatagtataaaaacaggcatatatttttattgttactgctctttgtattgactattttatttgtaaagcagatgcattctttcaaatgtttatagaagaatgcagtccagtagaaaaacatatgattatgccccttttgccagagggagatgatttgagatccaaaactcatagggatgttattaaattgagtgatatgttcatagattaagtccctgatttggcttcttttctttaagcaaaacggtagacttgatgataatgattgagtccccactgttgatatgatgatttcttatagtagtaggtaaatttggggaatgctttactttgcattttcttatagttgcatgggttattttgtggtatatagcagtgactaatatctaatattagaatgctaattttcttacaagtatcttatatttgaggaaaaatacaaaatacatatgtatagtttccttagatttttatgtcaagtccatttagatactactaaacttctgtcttttacctttatcttattcagaattaaatatttcccagggaaaaggggaagttaaagaagtaatgcaaaaggtcagggtttttcccatatcccctatttttactgagtaattgtattaatattgctgataatagtgagctctggaggctagcaatgaaaaaaccccaaagactc

SEQ ID NO: 9435 - DNA, 1262 bp, artificial
  synthetic oligonucleotide
tttagcccttccaataataaaatgtacacaactggaaatgaaagtcctcagacacatgtttggcaatctattagaaattgcaatttgtatagatgaccccataaatctaaagtactggcactcatgaaagattatttccatttattttgtttcattatgtaatatttttctctaagccaaggtagtattaggtcctgccagtgctatactcataacctgatgatttcatttattttgtaaacatctgcagtcttagacctacctatttaagtcattctgctattggcagcgttaactgaaatatattctgcaaccaaggtcttaaaatagagacctattaataatctattgctacaatataaactggctaaaaacatgaatgtctctttacattctaggctttaaataaaaagtaaaattaaggatacatcttaatgtgccatttggatcattaacacatttgtgtagaaattaagtttttacattttgaaaattgttgctgagccagttacttttggaaactcttagagatcagatccttctaatcagtaacacgcttctttctctgagtgcagatagaatgaagagaggagaggatgatagcattatttgccaactctgtggctctccacttttccctccataataagttagcaaattctttttcttgctttactttgattacccagggatagattcactatttctaagtttcatacctaaaatggttttacattgcagtcttggtttacacttgttttcctggtgtcattattttcaaaatcttcattcactctcaaaagctttctggtttggacgataacatatgtggtcctccttctaatcacctcttcttgacagcctggtgaaaaagtggtccatgtttctatttaggtggtatcaccacatatgtccaccagggagtgctcttgtttttggcttacatccctcagctagaggtggtttttctcctggcaaattttaagtgaggagaaaaagcctgtggatttctgtgagaagacatttaactagacacaaagctctcagtagaacttctaaaacttggaagcaaaaaaataaaaacacagtctaccttgaaaccataagaaaatatcagcacctgtagaaggaacagaagacagttattcctaggagaaaaataagaggaagcatctagggttctagaaattatgtattatgtgattatctgggaattataattcagagagaatttatgagcatgtctctttcagtagtgatta

SEQ ID NO: 9436 - DNA, 503 bp, artificial
  synthetic oligonucleotide
tcgtctcatcagcatcactgaaaagaattgaaatcacaattactatttttagttatttctcttgtgtcatttcttacttttagcataaatggaagctatttaaatatttagatcatgaatttggatttgtgtctgctgttctgtgtgttataaatttggaattatgttatatattaatgatatatgttaagaaatggtgaaaaacaaaaaattgcccccctttcaccaagtcttgttggggcctgagatattctaagagaatgtattttcagatacaataaattgaagtatactttctgaaaatattttaaccattttaatggaagtgatcctaaatcagtattagtcacctcttagagtgtttgttttctattcctagtaaccacaaacagtggcttaaaacagcacatttattctctgaatttccatgggtcaggaagttgagcacaggttaagtgggtcctctgctcaggatctcatcaggttgccaccaagagggtgac

SEQ ID NO: 9437 - DNA, 3935 bp, artificial
  synthetic oligonucleotide
actaatgcattcctgcaaatgtgtttctccggaaaagcttttggggaagggagattattttacctaatcccttttcatctatgttatagaatatttagtgtgcttatttgaccttgagagttatacctcttgtcattaggcaaaggaaggttagctaaaggaaaaaaaaattacatggagcactatccttataactttaggttaaaataatttttccatacttaaatatacagagtacattgccaacaaatggaaatctctgcttttggaaggtgaggtatataggccaaagtacaactaaagttagagaacgcctctctctctcctctcccgactccatttcttcctcaggagagattttcccaaatgacgccagctatggacctcagcctgtccacacaggggaaaagctcacctttccaatgaagcaagccaaagcctctattggaagcaaaccctggccttccttctccagagcttgcatcttgacctgagctttacactgttcctttctttccccattgactaggctgttgtgtgccttagaataggcttgctccatatactgctactatttatatcctcctgcttcatgctgattgacctagctttgggctctttacttgccctgatcttggatagtttgtgtacgcttccttactggcttatcttgtggattctgatccatttcctgctctcacttctagtaccttctcaagcaatgactactaacactctgcctctgcttccttggttctttggctgggcccttgtaactcattgaattattttgcagggctgaatgcagagaagcagaagaggatgggactgttcaggacatttatatgagtatgtaacatgaacatattccagccacaaaatagaagctagactttctgcccatggctgtgtttataacatcctctctcagcaagtcaggaactggttattccctggaatctgattttatgagtaagctcagtttcagatgtccacatttgaagtacttaactatcaattctttttttaaaacattttttatgtcaaagggacatcaaacacagcccttcatgaaagagctcgttcaggcccaataaatggtcagtgaagggtcaagagtatattgtccaaaaataagggagaggtttatgatataaaactattaatttctcctctattttttgtaatttgtctcctattgtaaatgcttttattgtccctagggaataggaactaaagactatatggttttctgttgatagttcaaattcaaatcttggggtccttattctctctcaaaagatggactatatgaggctctatgtgggaggattagcagtatacattcacagcaccttgattctctagactgaaaggagctcaagggttattttcaacatttaacccaggttctagcttggtaactggagcatggtatgtatttgagaagtaattattgaattgggtcctggctatctggatagctagctgagtgacattgtcctagtcttttcatttccatttaatagatgagaaatatgaggctcaatatcacctcttccacaaggagttttgtaactaagataatgagagcaattttttataaattaaaaagagaaccatacaaactataccactttgcattagttttttagggctgctgtaacaaagaaccacaaactacagtgggaaaaaaaaaaacaaccaggaacttaatctctcacagctctctagtctagaagtctaagataaaggtgttgacaaggtcatgctttctctgaagaatcgagggaaaatctgtatcatgcctttctctcagcttctgtgtttaccagctatccttggtgttccttggcttgcagtcacattaactccaaactctgcctccatattccatgttcacagggtgttcttccctctgtgtgtgtctgtctctgtgtacagatttccccttctttttttttgtttttttgttttttttgtttttgagacagacttttgctctttggcccaggctgtagtgcagtggtgcgatctcggctcactgcaacctccacccccagggttcaagagattctcctgcctcagtctcccaagtagctgggattataggtgcccactaccacacccaggtaatttttgtatttttaatagagatgggggtttcaccatgttggccgggctggtctcgaactcctgacctcaggtgatctgcccgccttggcctcccaaagtgctaggattacaggtgtgagtcaccattcccggtccagatttccccttgttataaagagaccagtcattttggattagagcccaccctaatgactcatcttaatttgattacatctgcaaagaccctattttcaaataatgtcacaatcacaggtaccacaggttaggacttcaacatatctttttgggagatgcaattcaactcataacacatgcacgaatctcttacacaaagtcctttggccagaggtgttttggaattcagatgttttcagatagtagaaaggcagtacagtgcatataccatctattaagtattactcccaccacgttgtagagtaacaccatgtgttcaaacactgtattattttcacagaaaatacaattatattaacactaagtgagataaataaagaactctgatatgatcttatccattcagaacccactttactgccaaatgagtttcaattttttgtttagagatttttttttttttttggataacagaatggcagataatgagtttggggccaatatcaaatactgacttggataccattcctctgaaaatctttgtctcataatatctttcttcctcagccccgttgtcattatcctagttctggtcctcattaattcacagctaaaccaccataccaggttcctaattgtctccggctttcacatattcataactttctaaccagtgtctctctctctctctccctctctctcctctcttcaatcctgtttacactctgttgctagattaatctttctcttatacagctctgactaagccattcccctggttagtaccttctgttactcccaatataaaagagtttggcgtaaagaaatgccaaactcctcaatagagctttcgtgcttctacaacctggaccctcttcttccctgcaggttccctgggtgagaactcaactggactgctcacttttttttttttaatcacttgccccataatgtcctccctgtatgtgtgcctttcctctctgctttgaagatatggaccccaagccgtgacttctaaatatccaggctctacccatctatcaaggccaagttcaaatgatacctgcaggaagctgcctttggccctttcagttggatacaacctcatttcctccccttgccccataataatgatgacgataacatttttaagcactcactatgtgtcaggaatgttcacagtgctttgcatgtattaattagtttaatcctcacgacaatctgtgagataagtcctgtttgcagccttgttttatgtatatagaaactgaggttcagagaaaataagtaactttcccaaagtcacagagttgttagtggcagatctggaatttgaacacgtgacatctagctccagagcttatgtttaaccaccgtaccctttattgtactcttattgtatcatttatcactctctcttgggttatgaatatcaacatctatctcctgatctaggtgctaactctttaatttaaaaagttatctggatttttatatttgtatcccccataaccttcagcacagtactttgcacatagcaagaatttatttactgtttaaggtgatgcaacctacagtaatatatggattaaccctgcaatcttaatggcttaacacagtgaagtttatttcttgttcacacaaccagtcattgtaggtgtttc

SEQ ID NO: 9438 - DNA, 1352 bp, artificial
  synthetic oligonucleotide
taaaaataatgttgatgaggatgtagagaaattaaaacccttgtacattgctggtgggaatgtaaaatggttcagccagtaaggaaaggagtttagtgattcctcaaaaagttaaatgtaaaattaccagaataccccgtgattccactcctaggtatgtacccgaaaaaactaaattgatattcaaagaaatatgtatacatacatgttcataatagcactattcacaatagccaaaagatagaaactgccaaaatgtccatcaatggataaataaataagcaaatcatggtatatacatacaatggaattttattcagctgtaaaaaagaatgaattcctgatacatactacagtatggatgaacctttaaaacatgatgctaagttaaacaagccaggcacaaatggttacgttgtatgattccatttatattaaatatccataataggcaaacccatacagacagaaagcagattaatggtttccaggggctaagggaacaggaatggggagtgactgctcagtgggtacatcccccattggggggatgaaaatatttcagaactagataaatgtggtggttgcataacattgttaatgtactaaacctcactgacttgtttactttaaaatggctaattttatgttctgcaaatttcacctaaataaaatttaaaaattaaaaaagaaatctcaggaaaactgaaagtatagacattgaaaacccctaaagcttactaaatatctgtgccaaagcagagaactgggcttgttttcctagttcctttctatgatacttttttctgcattcacatgtttggggaccattaaacataatccataatatcctccaccatgtttcttttctactttatttcatggaattcttggtgtctatattagtttcctattgctgagcaacaaactaccacaatcttagtggctttaaacaacacatgtttattactcacaatttccctgcatctgtaatctggtgtggagctaggtcctctacacagggctttacagagccgcaagctactgactggaccgcatgctaatgtagaagcttgactgtggaagaatcaacttccaagttccttcagtttgttgggagaattcattttcttgaaactgtaggactgtgtattctggtatttttctggccagtgaatagaggccatgcttagctcctagaggccatcctcatgttctaggggttatctgtagttccttgccatgggaccttctccataatggtcatttactaaatcattcttatgaggagagtctcattccagtttgcaaagatgcagtcttatataaagtgacataatcttaaaagtgaa

SEQ ID NO: 9439 - DNA, 1145 bp, artificial
  synthetic oligonucleotide
agatcttaattcaaattagggtcgctgctttttcagcgttttcagaaattcggtgtgtatagaactggaatgctccctgtctttttcccctttccataccctgcccccaacaactcacactaggataggtccttgtttatgcccataataccttgtactttgtagcactaagcacttttgtaattattactacctttaaaaattaattatggtaaagtatatatgtaaaagaatgtatagggtagtacagtttaaagaaggaaaagtaaagtaaaaacccatgtacccaccacccagataaagaaatagactagcaccagtacttttgaagtctccttcatgccactccccaagtaccgcttcctgtccacccagcagtggccatttccctgaatttcatgttaaaattgtcttgctgttttttatggttttaatacataggtatatatcactagaaaatatgccatttagttctgtctctttggtcaaggttatgtttttggattcatccaggatgatgtatcaaattaatatatttagtcattctacagttaatagatgtttgttccctatttgttcttttcttatgaataatggtcttctgagcattcctgcttatcttatacctaagactggaattgctggatcatagactgggaacatgtgcaagttaactaattaatgccaagtagcggtgttcatttcggttcacatcactgtgggatgaaactttcatcactctatacctcattgatgcttggcattatccaaatttttaattgttgccaatttagtggcatgaagtgatttttcattgtggttttaatttttatttcctggttactgatgagggtgagcatcttttcatatgtttattggtcagtaggatttgttcccctcggaaatgtctattcatgtcttgtgtgtttttctatctagttgtcattttattgatttggaggatttgtgcatatattctggataataagtccttgtctcctctatatgttgctcatgtctacttatggtttgtggtctatatatttactctcttttgggtgacttctgataaatagaagttctttattttactataaatgaattcatccaaatattcctttatgttttatatcttatttaagaaa

SEQ ID NO: 9440 - DNA, 1153 bp, artificial
  synthetic oligonucleotide
ttctttaattcacagattcttgctttgatctaaaatcctcttgaatgcttcttcccttaaatctccagtttcatttatttttaagagactgacttatatgaatgcaactgactttttcaagtaatatagattaaacatttctgggtggccacacttatttggattacactggaggattctctttgaattatgctaattttagcacccaccccatcagcaagtaagtggcatgggtgtgagttttaatcctttatctaggtttctttctttcaccatggctgaggtaacagcaaaaagaaaaaagaaaagaaaatcttactcccttcctggagtttgaactgtgcaagactatttttatatatacttattttttggagatgggatcttgctatattgcccaggctggtctcaaattcctgggctcaagcaatcctttcccctcagcctcctaagtagctgggactacagatttgtgactattcctggctgtacaaagactttccatgtaaacatatcttatccatgttgtgacttccttccgctaatgatctcccctagccattactactgaaagtgtacagtgtaatgaactgttctgcatgtacagcactgttataagacgaggcatttgtgagaccctgatggatgctcttttttgtgtaagtttagctttagagtcacaatttacttccttaatcagagcagtgcttttcatgtcattgagtaacttttatttgcacaatgtattcacagcaatatgcttttgcatttgtaaatttctggtgccttgaacccttacagtaggatctgatcatttgcatttttacaatgagcacctgctcttgttgtccctcagaaccaaatactggtcttactcgtgaatggagggaaagctcatcagcttccttcagcttgcagagctggacttaacaggaaccgggaatacacggagaagaggatgatttctaggcagatgtgtgtgtgtgtgtgtgtgtgttttttttttttttttttttttaaggaagctgaccagtggcagctggagtagctttgttcattacagatgttattggcactgtctttgtagttttctctgtgaagaagaaatggaagattggcaggaagctccactagggggagatgaccagtatct

SEQ ID NO: 9441 - DNA, 1675 bp, artificial
  synthetic oligonucleotide
tcatgatgccaaaaaaaaccctaccaaaaccaaaaatcacagtgagggtgtatcctgaaatcttaaaagaaagtccaaactatttattattgcaggttgtattttttaaagttatttccataagtgaagcaggcacatcttgttcccaccacaggtgctttctggaaaagatgtcaactgaagaatgacaagattcataaatttggaagggagagctttatttcttataaagggttgcagcctgcagggtggccattctggcagactgggaagtgtagcctctggccagaagctagaaacagacacttcaaggcagtgggtaaagagaacaggaatttatgctgagcaaggtggccaaatatacatattcaggaggagccatagttatttatgaaaagagaaacgtgtatgtcatgtgcaatggagtgtcacgtcccttcaggggtcccatgtacaaagaatggcagcattagcaccatccaagggtggagtttttggccatttgacatcaaaaggtgaagcagaggacatgaaactcctcactgcatgtcctcaatagattggccagaaccattccataatgggaggcccttatcaggaaggaatgctggtgggttgttgtgatgaaactgcagaaggacagcagtcaggtggttggttgatatggttgatatcagtggtggagtcttttgaaagggctggtttctgtttaacccttagggaaggaagcctaatggtagttagtgaagggtggttataactagccatgtctgacctcccaacctgtcagcttctcaggtttctctggggtccacttggccaagagggagtccattcaatcagtttgaggacttagaattttatttttatttcttacgatataaatgcccttagttgacatatgctccatctcctgtttctttcatggtggggaaaaactacctcagcaaacagtgatcagtgatgctaaaaacagctctgttggtggctcaagtgtttcaaatgatggggcatcacaagatggatccaagaaaccctaatctgtcagtgttaagaaggaacagcatacacagcaagcagcagatgtgttagcctttccagcagctggggtgtgtatcccagaacaagcccagcatatcacagcacaaattattacaatgttggggaataattgtcaatacgaaactactttcttgtggagcggttaggatttcctatgcttcccctccctgctcctccctccagatttcctttccagcttgtgtgtatgtgtgttgccaagaaccatttggattttaaaggctgaaaaataagtcaaattctttctcacctggggttgattggttgccagctccttcctccttcgggtgtcatcatgttcgctctgtcattgggaaggccatgcattgctgccaaagaggacctgagaagcagcttgaaattcagatgcatcagagatacatatcaggggctgatatgttgaaatcattgtcagttatctcagtttcctgatgcaattttttaaagattcttttggctcaaagtgtggttaagaattttgacttccacatggatatttgaagatttaaatatcctgtaatacaaagatatatgtgccatatctccttatggatttattttgtctttattctctattttaattcctgcagtttat

SEQ ID NO: 9442 - DNA, 1695 bp, artificial
  synthetic oligonucleotide
gttacagaatcaggttggtgaggactgggaaaaagagttggaggagaaggggagaacattactgctttcccttataaagtggagaaccaagagacattgcctatggtgcacagaacataaaatagaaaaatagaagcatgttttagaacgcttaagaatgctgtcagtgacagcattgactaatggaggtcttgatctggagatataactataatatatgtctaaatataagtggaccctgaatatgagtcaaaccatcattttcctaaatgagaaagttggaaacaacttttcttttttcaacttgaatatacaacatttaaagaaagagttgaaatagccaatgtctacctatgatattttaacttttagttatatatgtatgttttaaaccacatgttatgtaaactacactgttatacaaaattgctctttttcactctcatatttcatgattttttttcaaatggcgacacatgcacattggcattcatttctccttcatctggagccacttgaaaacatagtgccatatttgcttccactaagttgtttgactacagcactttttgaatctgagtttgatgttgccattagaaattttatcctaatttacatctactcattaattcgtagtaagctccacaacataagtatttaatgtattttaataaagtaattttttaaaaaagcttgtatgcagtggcatccagaactgctgtttgaagccatttctccagaaatattgactcaatctgtgttaaatttatttaccctcccccgtcatgtcagataccctttataaacatccaaatctagctttgattgaggtcatttcaggttactgtgtcttccccaaatagtaatttgtcgtttgaaattaagtaattgagagactgcttataatatgaaggtcttaataaggactttattttttatgggataattttgagcaaaagtcttgccttatatttggctacatacggacttttgggaagggctactggaaacttgagggtaaaggaagtaggttaattcttcatctctagtaccagaaaagtaaaagaaatatcttattttgataaaccaagaaattgtcacataaagcacatactatctagtgatactgagacaactactagatgatcaaaaaccggtggtagtttcagttagtggcttgtggggagccagattgggacagggtaagactgagtcaataaattgttcttcattataaaagcacctgaactatgatatcttataatgaaaaaaaattaaaacttaaagcggaatattacagtccaaatgagaaatgaaggactgtgtcattggtaatgaggatggaaggcagaggttggttttagagctgcctgagggtagagttgatgggatttcatgcctggattatggcggttcgtggaaaggtaagaatgcaagattacttctgtctagtctcccagctttggtgactgggtaaatatgatgctgagttggaaatgcatgaacaggggagtgaacaacaattaaatccattgtgagcacataaactcttagtatctgtgacctagttaagcaaagatgagtctggggctcttaggagagacacacatttagagttcatcagcatatgagtatagatatagccatgggactggatagattacccagcaaagatgtttcatgtaagataacaag

SEQ ID NO: 9443 - DNA, 1378 bp, artificial
  synthetic oligonucleotide
gtatcctgatagtggtggttacacaaatttaaacaggtaataaaatttcatagaactatatataccgcacccccccaccaaaagaacacagaaaaggagtgaaatccaaacaagattattagttgagttaatactattgtaccaacgtcaatttcctcattttgacaatgtgctacagttatgtaagatgttctcatttaggaaagctgggtgaagggtacacagagctctgtattatttttgcaagttcttgtgagtcttaaactatttcaaataaaagctaagactattgtgtagctcaggatcattttgttttattgtcacctttacctcatggattcatttttggtttttaatagagacgtgtaccataagtaagccagattattagcttttatttataaaagacaaaataatatctgatcaatatatgtttaagctaatgcagtagattataatccagatcatgaacctaaattgctcttaataagcatgtagtcacaaagttcaattataggtgaaaatctgaaattaaacaggactgccatttagtttatagttttagcatattttatttttggatagtccaggactcatctaagtttgccaaagattgaaatagtcacacaacacattcttaaagtccctgagaagtagaaagtagaggtggcttgcctactttttaaggtgagaatttctatttcagcagactttggggagggcaagcatcttctgtcttgctgatatgcctaagatgtgatctatttatattacaaaccatatgcagagcctggcaagcctctctgcaaatgagctcattcgctctgccctaaaggaggaggataggagggggcgaaaagacattagggacctttaacaatcattacacctcttgatgctgattgaacaggaaggataaacaaaatctatgatttctgacaggaagcataaataataaatacctgtcaaggggaactacatattctctttagtcatttttataggtcatcaaagtcaagttcctaaagacttgagtactttttaataggtttctctttttggcatgttgtacaaattacaagtacagataatttcagatttatcttgccaatgggcctccttcgaagtgtgataaattctatctagagcttcactcaaatcaactagtattaatagaacatttatccagtgttaaataattagatctgtctgtaaggaaataaagaagagcagttgctgacctcaaaaggttcccagacaaagaggaatgagactagaaaacaaagtgtattacaaaatgcaagcaccgtgagagaggtacatacaaggctcagagaaaggtatgaggaggaggtgtcatgaactgttttggacagtg

SEQ ID NO: 9444 - DNA, 1934 bp, artificial
  synthetic oligonucleotide
tctatgccataatatcttaatattagctgataatggggacatgagtttgggtaaaattgaaaccagtaaaatcctttgtttatcattgaggatcgaactagtaattaatggctttggtagccctgagctgcaattctccttggcctggtcttttttttataaaaaaaaaaaaaaatacaacttcttattttagagacagagagtacatgtgcaggtttattacattggtatattggatgatgctgaggtttagggtatgaatgatcctgtcaaccaggtactgagcatagcacccaataggtagtttttcaacacatgacaccctccctccattccccctctagtagttctcagtgtttgttgccatctttatgtccatgagtacccaatgttcagcttccacttgtaagtgagaacatgcagtatttggttttctgttcctgtgttaattcacttaggatgatggcctccagctgtatccatgttgctgcaaaggacatgatttcattcctttttatggctatgtagtattccatggtgcatatgtaccacattttctttatccagtccattgttgatgggcatctaggttgattccatgtgtttgctattgtgaatagtgctgtggtgaatatgtgagggcatgtgtcttcgagtagaaccatttgttttcttttgggtagatacctagtaatgggattgctgggtcaaatggtagttctgctttaagttctttgagaaatctcctgactgctttccacagtggctgaactaatttacattcccaccaacagtgtataaatgctctcttttctctacaatctcaccagcatctgttgttttttgactttttaataatagccattctgactggtgtgaggtggtatcccactgtggttttcatttgcattttcctgatgattagtgacgttgagcattttttgtatgtttattggccgcttgcatgtcttcttttgagaagtgtctgttcatgtctgttgcccaccttttagaggggttatttgttttctgcctattgaattatttaagttccttatagattctgaatattagatctttgtcggatgcatagttaaccaaatattttctcccattctgtaggttgtctggttaccctgttgacagtttcttttcctgtgcagaagctctttattttaattagatcccacttgttaatttttgtttttgttgaaattgcttctgaggattcagttacaaattatttcccaaggtggatgtccagaatggtatttcccaggttttcttctaggattcttatagtttgaggtcttacatttaaatctgtaacccatcttgacttaatttttgtatatggagaaaggtatgggtccagttttattctttcacatattgttagttagctatcccagcatcatttatggaatatggagtcctttccccattgcctatttttgtcaagtttgctgaagatcagatggttgtaggtatgtgactttatttctgggttctctattctgttccattggtctatgtgtctgtttttgtaccagtaccaggctgttttggttactgtagccttgtagtatggcttgaagtcgggtaatgtgatgcctccagctttgttctttttgcttaggattgttttggctattcaggctctttttttggttccatatgaattttagaatacttttttctaattctgtgaaaaatgacattggtagtttgatagggatagcactgaatatgtagattgctttgggcagtattggtctggtttcttttatacttcaccctatacaggagggtgagacctggaaaacatactgtctttgctctgtgctttgcaaatcaaccagtataggcccagagagacaaactctccagcaccttccgtctcctctcctttgcacttctgctgcttttcctct

SEQ ID NO: 9445 - DNA, 1843 bp, artificial
  synthetic oligonucleotide
acctctgcaataggtaaatctgtcagaacccacagaatgttcctttataaagaccacctgccatctctaagccttcagcatgagtgttttattcttaaatctccatatggcatgaagttgccttttctcctgagaagtctcttaagcttcttcctgttgttcttgagatactaaaatgtgaatggtgccagaacaagtcaccagagacgtctgagccaaaaagatttaacaaacagacacacagacagatatttgcctaaaagtctgtgcatttggaaattaaaatatccttctattctcatcccaaaaccgggtaggactgcatgatatttgaatgataaatgaaaaagtgacccaagaagaacacattacatcctctatcacccttagcttctccttatttgtgtagtataaagaccatgggttacggcattatcaatagcaatagaaaattaagcaaaaaattagtttttcaaaaggaagttactaatataactgatatatctgtactacgtaaggactttttacttcgtaggaaatatggtatataatatctgtctatccctatagcttgtccaaagttaggatgatataatatgtttttgctttccttcacgattagtttaaaatcatattggaatttaaaggaggatttagcagaatatcaacttctgtgagaaaatgatgaaaggaaaaacaattgggtcttttgaatgaaacaggttgctgcgggtggctataacaagtaaaccacttaagttcaatggctaaattaaacaagacaggagcttaattctcacttccataaaaaaacaatttgaatattttcggtcactgggcaggcagttatcctccatggagttctgctatcccctaatgcctcaagtcctctgcctcaggaaaagagaatagaaaaggtaccagtgtctttgaagacttaaactgaactgacaaacctcaactctatccacacatcagtggtgagaactagtcatgtggttacaactggaagcaaaggcagctggaaaaggtaatgctgggtggggcagctgcctcaccatgaccacagcacatgatcgaaagggcagacaattatcagtggacagatggcatcctgcatcttgccatcatgaatgaacctttataactcaaaataatttgaaaaaaagaaacttagccattgttatggattggattttgtcccgcaacaaaatatgttgaattgctaagctgcagtacctcagaatgtgaccttatttggaaacagggtggttgcagatgtcactagttaagatgaagtcgactggagtaggaagggctcttaatccaatatgactgatgtccctataaaaaagggagagacacagtgagaagagagccatgtgatgacagaggcagagattggagtgatgccctacaagccaaggaatgccaaggactgccagcaacaccagaggctgaaagagtcaaggaaggggtctcccctaggtgcttcggaaggagcatggccctgccaacaccttcatctcagacttctggcctctaaaactgtgagacaataaatatctgttgctttaaagccacccagtctgtagtgtcttgttacagctgcgcttagaaaccaatacagcaatccagtaccaacatggaggacaaaaccgtcacaccaacacttcccaggccctgtgtcctgcctacctttgactcttacatatctctactttatatttgccaaaggaagcctggctgatggtggggcaatggggagtggggctggttggacaaatacagccctttagtcatgactccatcagcctcattcaaactctctcagagagacagt

SEQ ID NO: 9446 - DNA, 652 bp, artificial
  synthetic oligonucleotide
tgggggcgggaagagaacaagatggcaaaatatgggggagaagggagtttacattttgaatggcaaattacaggcacatacttaattcagatgaaaaactaaagctgttaaggataaagaagcaaccaacaacattatgaaattggcttgcttcagaaatccccagccagaactctaaactcatgcagttgttttctgacacgaagtctgggagatcatttcttatcggaaacactcattttttgttcatattcgtaggcagttctgctgactgttgttggcttagcatagcacatctggtcaggaggcctcaattgggcaaatctgaactgcctaaaatggtgttgattcatataacctgtgaaaacatggattcaaattaacaagcattagggcagatttatatttttcctttatttaagaacgataatgttcagtggaagtgatcgtgagggaatatctggatccagatgtagtggacagtcactgacactgtatggatcaatggcagacccaacattccctgcctttttctgaaaaacctggctccttcagcaacatcatcattagcaaaagccaaaagagaaacttgccgacctacactgggtaagtgctaacttgtctcggacttctcacttttctatttggatca

SEQ ID NO: 9447 - DNA, 972 bp, artificial
  synthetic oligonucleotide
tgggcctggtttccttatcagaaagtcacagataacaatcctgacatgtcaccagggagggctgcaaggggagcaagcagaagggcctgcacctcagaaatgaaccctttccttccaaatatgaaatccattaaacaaagcagggactccagctcccagatggacactgatgcctgccccccattgttagaagcctgcagccattatgtgggaattagggagggagagaacaaaggaagagaaatggcccacctattgaacccacatagctgttgtgtggcagcttttgtttttggatctgttgcagctcacttttccacgtgtgtttgggtgatcttccagattctagggatatatggtgaacataacctagaccttctgaattaccggacatttcccgactcccatttcaactctagagaatggggttgaggagggtcatgtgaaatgtagcctgaggcctacatttcaagggcctggagacaaggtaggctccatgcaggagagttgccctcaaaattccctttctgctttgattaatgaaaaactgttaactgcttttgtgggactaaatggaaggttcacctgtttcaaccatctgccaacataaatagggaaaatccttattattttatatgaaacaatggatctggatttattaaatattattgctattttgacacaatttgtagtaagtatgtcctacagtttagactgaaggcaaatatttataaaatgtgaaaaattaatttttaaaagaactctaaaattacttatatccaaagagaactataattgttttaattagccattaatagttcaacccactgtgttaaaaccatgaactcttccagaagtatttacttacactaaagttttatcttgagctattactgataatgtctcattcattagctttctgcctgggaactttacactatttgcaagccacatcttatttagccattataa

SEQ ID NO: 9448 - DNA, 1802 bp, artificial
  synthetic oligonucleotide
gagactggtgagctgctttagctacagtggtgagaaaagacctttctgaagaggtggtagttgatttggactaagacaataactctaaaggtcaatgatagtaaccctatatacattgagcaatcaaggaaaacctaaaccctgagccttaataaccctgaagctttctctaaggtttgcctcactgttcttatgagaaaagtaaagtctagcttctctcaagagacctagtagaggcttttttttttttctttttagacagagtcttgctctgtcacccaggctagagtgctgtggcacgatcttggctcactgcaacctccgcctcccaggttcaagcgattctcctgcctcagccttcaaagtagctgagattacaggcacgcaccaccacgttcagctaattttcgtatttttagtagagacaggttttttgtcatgttggccaggctggtctggaactcctggccttaagtgattcaccggcgccggcctcccagagtgcggggattacaggtgcccagccctggtagaggctttaagttatcacctgccttgatttaatccagtgacgcgcacctttaagagaccaggtgttccaattcaacccatagagctacaatcactttgaaaagatagtacttctgtgacttaaaaaaaaaaaaaaaaaactatttgtaaaaacacttcacttacactcgaaatatagtttccagaactaaatttagttttggcacatatgccattggctgacttcctgcattatatttgcctttaagggcatgttcactttctagttctcatgcattcagaggctgccaccagttgcgttcacagccctgcgggggcagtgtttaaatgacctcccatgttttcattaattcttaaaaaatcttacacaaacatttctggtcatattaggttttgcaaacctttgccctcgtgctttttttcttttacaaaaacctaaatttggtgcgtagactaatttgacctcataatatatcatcttttaaataaatacaagacttgacaagatccagaaactggtgctgaaatggaagtcaggatcctctccagttttctgaggccaggtcaacagagctataatcatcccagataactcaagggggaaataaaacgctctattttagggagagaaaataaacattcaaggagagtatctatttttgggaggaattgatgacagagctcttgatgagtgctacctgaattcatcatctgcccaaatattttgtgttatttttctggagcctactttgccttgggttggtcctgaggtcatgatttcttggtcataaacatacaagagaactcaaatgatcagtaataaataaattaattaaacatgactccaggagtcaaggaactactccttacctcaactaaccatgttccaatttggttaagtctctaaaaattgcatccctttagcttgctagtctgatggtgagaacagtgataaaagtccactaaaacatgtcaggtatctttgttcactccctcatccacagtgagcgagtgctatgtaaatatcaaatgccctagtagtatttaacagaatcagttcactgtggctttaaaagaaaataaatatgtgtcatctgaagcaatgctaacacatatcactttcattacttgttaggctttgaaggataatttgtagaacacaatttccaagccattatttttaccttattatttccacagaatccacaaggggaattaaacaggatagctgggtagtcacatgactaattctcatggaaaaatagcagctt

SEQ ID NO: 9449 - DNA, 2351 bp, artificial
  synthetic oligonucleotide
ttagatgggtcctaaatccaataactagtgtctttatgagagaaaggagaaggcaaatggaatacagacacatgcgtgtgcacagaagaagaccatgtgaagacagaagcagaaattagagtgatacagctacaagccaaaaaaccgccaaagattgccagtaaccactagaggctaggagagaggcggaacagatttttccttagagcctccagaaggaaccaaccctgctgacaccttgacttttgacttctagcctccagaattgtaagagaataagctggttttttttttaaaaagccacccagtgtgtggtagtttgtcatgccagccctaggaaaattttgtatttcttattgccacagcttggttctccttctttcaaacagtttaataaaacccaaggaagtcattgagcaaaaagcaatcccaaagaattttaaaagaagacaagagaatggctaatgaatgcttatcagtgtttcatttccaaaggaaaagtgatggattagaaatcctgtctcctgctaagcatggtgtcatcattatgtcagcagccaagctgcagttaggtcccacgtgtgcacggctccgtcttctttcaggatggacttcactttccccttgggggacttctgcccttctgtgcatttgtttcaacaaaaggggctcaaaccagaaagagacactcaaattcagagggctgagatgctttggtttgccttttttggtgtttaatttgctctgcattaaaggggctgagcacacacctgagacacaaatgagctcgagtgccagaacaagccagtaagaaatgtctttaaaaggagatggaagctgctgaaactcttcaacaggcttcatggaaaccaaagcctggtaagcctttctctagggaaaacttccggggatccaattgaaaaagcagagctgcttaagctaaaagccacatgccctttatttgcctcctgtatgatttattgggaattccttgggtatttttcacagttcactgctttgtagcatgacacagattagagacataccaaagaactctcagccccctttaaagatataggaaggaaaataagacattcacaagatcgtaataagcaggttgtggatcagggagctaaaagtaaggggttccccccttttaatagaaacggcttcacgaaccagttttatagaattggcaaaagcaaactgatggaagttgttggaggtttatggagcagtaagaaaaatgcagtaatgagaatcatagatctaactcttagtagatgcttggctactaactagctcagtcatctaaccttgtgcaaaggaaacccctactcaccatttaagcctacttggtttaaatgtctcttgctctgccttaggctcctattccagttaagttagttctcatggtataactctcctactctcagaccttccctttattatagcacttaccaaagtggtaagcatatgggattcattagtgcaattatgcatgttcaatccctaacatccctaagaccctaagtttcatgaagcaagagtcatcactgattggtttcccttgtaatcctagtgctagaatgactcatctcacgtaagaataaaggctcgatcgataaccataattcacctcttaacctcagtctcctcatctggaacttggctcttcaggtctctgacagctgtcgccttctgtgtctcagagaccttggacttatcctcaggcatcagtgggaagttctattaatttgacttgtcacagaagaactaaaatgagtgataactatacagatgtctgctagtcaaaattgttaatatttcgttaaatgtatgggctttgagtcagacatctccaagttatagtcctaagtgtgcatggtgtgtgtgtgtgtgagagagagagagagagagagagagagagaccaaccagtctaccttgggtaaagtcatttaattcttcagaggctcagttcttcctctggtacacagagttaatagctatacattgtaaagcatttagtatgttttgtggcatagaacaaatacaaaataactgttatctgttattaataaatttgttatcattaattacagaaataagacacataatatggcttattcaggtttgcctatctgtacatattataaaattgaatatctaacaataacagtagtaatgagtcaacctttaatatgtatcaggtactgtgactagtgtcttacatgggttattttatttaatcttcacaactcgttgaggtagttctctatcatcttcattgttcaaatgaggaaactgagtcactgagaggttaaaaacttgcttaagtgagctagtaaat

SEQ ID NO: 9450 - DNA, 829 bp, artificial
  synthetic oligonucleotide
ggatttttttaaaactattttgattttcaacctgactgctattaggtttaccttgcagtcatagtggcttatggtggattcattcattcctatttaaggcattctatttaactcttgtttgttatatattctctttgtttatatagactcaactcacattggcctttctgatcaactgtcaggttatgccaaattcagttaaggaagatctatgggttttggttaccaatttcaaaaaatggctggttttgttacattgcttcccagaatccttcttacaattcatcagctagcttcagaagcattataattggtagtcaagaaataaatagttttaatgtatatgctttcaaaagcaggtttctaagactttgctttgcttctctattagggcatttgatattgaaaatagtgcctatatttgttaattttttcctcagagacaaagttaatcaaagacttgggatacctttcattaaagagcagaacattctgttcactattcattcccaatgataattattgtagacatctaggatttaaaaaacatcttatgctatctattccatctggtcatggcacaagaatattccaatggaagttctagaatccttggactgacatcaagctatcctcttatcagagatcctagaaaactcatcagtattctttctattcccttgagagactgttctacaaacacacacatcttactatcaaaggatatattctgatgcttaacctaaatttccttttccttaactttatcccttgaagcttttcatatctccagccaaaattcctctttatccttggtgtttagacccca

SEQ ID NO: 9451 - DNA, 5004 bp, artificial
  synthetic oligonucleotide
tactcgcatctagtgggaagaggccaggggtgctgctaaataccccgcaatacccaggacagctctgtagcaaagaatcattcagcttcaaatgtcaatagtgccaaggctgagaaaccctgagccagagcaaccagaaaagttcaagaaccaaatctatatgaaccagatattccctccagggcctctaagcagccttgcaagatgctcattggctgacattttgatgtcattagtaaagactctcctttaaggaccaaagactcagcttgcctgcaagtgaaaaggacaggcagtgcccaataggatacattttcttggtttttcagagggttccagggcgttaaacctttgaaaggtaatccaggccattaaattagagatccaagggttatgttaggatatcttggcctttattaaacaaaaccagggttggagctacatgctagagttctatccaatcactccatgcctgcctcaagcataaaggaatttccaacacacacacacacacatacacacatattctatgagaaaattctggctttttgctagatggctacatccttagttttaaccaccatgaaaaggtaaaaatcatggtagatgagttttgtgcagactgcccactgtatggaatagaagccacccagtatcactgcagttcagatccttgtccattaattatgagatgctaatggataagaagataatttgcaacaagtgaaatcatctacagccacatgccttttggtcataacagtaatgagcagcatctgtatactatattccaagtatgtatatggttgctaagaaaagcagaaatgttcttaatgatgcaattagttttaagcacgaatgttagctagctaatccaaaatgctggcttgcttttgtatttctctttctctcaacttgtacagattaatctgataatgtgtgcttctgaaatacaatgagaatccagcccctcctaaagaccaagagaaattcaacatttcaatttttgatgctctttctaatcttgagttccctggtttggaggtaacatcttgccctctgcctcgactttcctttctactgcctatctttctcaagaaaatgggcaaaagacctagcaaaatttgttagttttttgtaatctgcacccccaacacctaacagcctcagttactttgacacagtaactaacattaataatatgtgatgctaataattctgataaatgatgcttatttttctaaggcggtttactaaagccaaagtctaacagttatctcacattaacacagctgagtatgatctcagatgctattttcaaacggttttccttggttgtgtatttagcctaaatctccagcaattacatggtatttcatttcatttctgtaatgctaactgtactttaaaatattaaattacaactgatggaatctcccttcccttatggaaacagatccaaggcaaacctatagagtttgtggaccgaaggggataggggctgttcatttttaaaacaattactattctctgaaagtgtgttattttcaaagcgcccatcagtgacagtttcccaataggtcaattcactatttttcttaactggacagcaaatattttaagggtatctgatagctccctctgagtcccctatgtattgttgattcttcactaaactactaattgttctaaatggaatttaggcatcagcatatttccatgatctttcacacccctacacagagattttcttcttctcctaggttaaactaatactcagtaccatagatttctgaaattgccccttcagggaaagaaaaggtgaaaactagagaattcttgtcccccctgccacccaaacacacacacacactcactcatacagtcaatgacaccctccaaaataatgtttctgaattctctacagaacaagatggcagacatatttcaaaatatatttcatccaatcgttacaaacagcttagcaatagatatttgagttggaaaaaatatcaacattgggtgaagggataaggtgaccctttgaaattgcctgcagcactaacagaaaaccagaacaccatctctttctccagctcccacgactgctccaaagtagagccaacaagtcctacaagacgcacaagcgggtggccactagggacatcccatttccaggcaccatttagcaagtagaagaggaaaacccacaccacggaaaccccttagtgggtgccttgctctgtaaatgtaatggaattaaaggcggtctcctgaaactgcctgggggcctcctccttgggccgtgggacgcgcagcgctggtccctacctcggatttccacacgacgtaggggtgcccgcgactgtcgggtggggactggaacttcctctgctggagccacctcctaggagaagcgaagatgccattggggcctcccccggatgaacagaggatgctggaagcgcttcggctactggctggcccggccaggacagaaggcaggtcccaggccatgctcttcttgaggccgccgcgacccaggggaacctcatagtcaaagtgaaagctgccggatggtgacttctcctgcggggtgctgggtgtggagaaggacgagcaaagaggtccaggaggcggtagcctggtggccctggggggcggaccccgggaagaggacgccaagcgagggccgagactctcggctgggagtgatggggagtagaggcggcccgccgtggctccccgcgcactgccctccgcgcccgcctcgtcgctcccgcagccgccgatcagggccgggtccaggctgcgggtctggcgcagcttcctcttggagaagcccttggccgaggccgcgctacttgaagcgggcgaggaacaggagaagacgctgtggagcaggctctgcgcggacatctcggcggggctgcacctgaggaccacctcctcctccctccctggacgctggtggctttgggtcgggaaccgaaagggactcaggcaaaggtgccaggcggggctggcccggggtttgcccagggcagtggagagcaaagcccagctcacgcgccgccggtgcgctccaagtgccccggcggcggcaggagcagcagatccatcaccagccttctaggaaaatgggtctggggacctcctgcagccgctagaaccttcctccggagcccaagacgcgaagagggtcaggaagaggaggaggaaggtcaggcgctcgctgggttcccagctccagcctgccagcgccactcccccttcctagctgaggcgggagacgcagcgctcctgctcgctggctctggatggcctctaagactccagcaagctcctccttgcggcccgaggacagtcccgagggccagggagaaggctgcctgggcgtgcgcccagggcgcgtccaccgcgctcccggcgccgcgagaacttcctcccgctcctgagccgggcgcctgagctgcgcctccctgcactctctccttgccccggcgcccgaggttgcgcgcctggcctccgctgggctgctgcgcccactcttccgactgcagaggctcaagggttgttccaagctcaaggttcccgcggggtctctgtcttgctgcagtgtggggacaccgagcgtgctgcgcccgggacctccaaagactgcgtgcccacggtgggatggaattcccggcggcgctcagcgctctccgtggaggagggagctcaggagacagccccaaggccgggtgtgtgtgttccgccggagaggaacacgctattcgcagcccagccttgggcccagggcagacgcggagatgaccccgtacgctcgctctagaggcagcgggaagggggcggccaggacgtgtagagctggaggaatgccggggctggagctggggcggagccaggagcaggagaaagcagaacgtgaagagttttccaggcgccaaacctgcaagcggcgaggagagaaggcagctcgccactgataccgggtctcctggggagaaagtcgtgaggacggaagtgcggaccttctcccccgtctccccacccccagatcaagggtcgcgccagctccactcacgtttctggaaaggaagggaagtgtcagattgcaccccacccactggtgtcagatgggcagccggggacgattgctctgaagttggagttaaatctcctgccttttctccccgcgcccccccaccccgccctgtcccggctgtttttgtttttaaaaaggaaggatagataggaaactgtctaaaagcagtggctgccgatgaatgagctggagatggagacctactaagaaagtggagggggaggagcctttgccgtggaaggggtcctgagcacgtgcggaaacgtgctctaggaggaggggtgagtgaggccgggtagggggcaggcgccgggcgcagcttcagcccagaggctgcagagattggcgctcacaaagcgatctgtctccgcgtcccgctctgggacgcctcgggtctcagcgcggtggccacagtcctgggaagctggagaacgctggggaaatcaatcttcccggcaaggagatgagtctgaaagcagcttctcccgctgtcggacccctggaatctataaagcgcaaagcctcgccctcttggagggctttttgatgtaacagttaagctttgcaatgcaacttacaaccatctcagcagggagcagacagaatgttggaaatgtctactttgtgtttgtgtcctcttttatcacttagggatgaagataattttatataaatgtaaaggtgactctaccatttcttttattttggagaaaaaatacaatgaaattataaatacagatgttggacacgaacattcctcttgcatatctaccagaattgtccaagtttgattctggaagacttcctttattccctatgacatattcaggggaaaagttaatttacttagactctttgaaaagcgtgtttggtgttcctaggtgttcagctat

SEQ ID NO: 9452 - DNA, 1130 bp, artificial
  synthetic oligonucleotide
tctttctttactgtagagctagcaagatactacagtaggtactaggaaggctcctaaagcttcccggtaacaagcctatctagagtttgtaggatgaaaaaaggtctccaatgacttggggaaaagggttatgtggattttctaggattctcaaggacaaggattgagatagggtttcttctccagttttcttttaagaaacagagtgtaaggctcacagaattaaatgatttgcttgtttaaaatcaattaagattttgaaaaagtgctgctgtttccctggtcatcagatcaaggctcaggtgggcatccacatttttcagtataatgtgaaactcgaagtactaaatcaaccatctttcagaattcttgtcatcacaagagaagcacaacttgttacaaagagtacactggtaaccataaaatatgaaattcaaattttggtcaggccaaatttaacaataacttcagtcaaccaaatatgttgcagaaaattttaggccatgatcaatttgtttaaaatatttctacaatttcactttgtgcaaagtgaaattaaaaggccctcacaacatccaagttgaaatacctactaataaaaatgttgcttcaatgtagtactttatttataaacttataggctgtaaacttacgcagaaaatcttgactgaaaggagaaaaataatctattaacaaacaggccatttacagttgcaagatgatgatttttttaagagccatttttagaaagatccttattgcccagcatccattacttagcatgtcatgggtttttatcatggtctgactactggcagcagacctcaaacataagagagttgaaatggccaagttgatgttcagggcaattccactaaactctggcaaaaggcaacaataataatatttggcataaaatcctaccattttcccagccactgctgggagtccaacagttagctttaacaattcataaactttttaaagttttattctaaattttgctttcattttcattcctcctgtattattcctctaataacgtatgaaaagaaaaaccattaacctaattatttgcactcctattcaagagctcctattcaaacctactacactaccagaaaacaaag

SEQ ID NO: 9453 - DNA, 1018 bp, artificial
  synthetic oligonucleotide
cccccaaataatgagtacactgttcagattctattgccatgtgaggaaggcaagtaggcaggcatttgggtgcccgacactttcttttaaacatctcattgtaattttgaatttcaagagcttttcctctaatctggatgtcccaggagggctgagaaatataagactatttctcccagaaatactccatgaaactgatgtgacagaggaaaatcctaataacaacaattgaatattcacagcctcacatcagcccccaaaaaagatggagtctttttttattgagagtatagggtctggccttaatttgtatgatctcggtaatgggtagaaaggtgaactgaaaaaaagcccagagaagagagtatgagctatatgagagccaagagcaaccccatcccggggagaaaagaatagatccagaaagtaagttgtggggcatggagtgctgtgagagaggaagctaggtggggaatggaaaaggaagagaagggagggaagaggagaacaggaaggaaagaaattatgcaaaggcagttcgctgtgatgaataggatttgggagttcagactgttgaagattttcaggatgattttctgtgtgttgtgcaatttaatttcaccataaagaagatagcaacaaagatttagtttattgaatttgtgttggtttgaatgtgacacccacttggactggataggaagtggcttagctttacccaagttatacaaatgaactgagggaattaataaagatttgccaggatagagctgctacacttagtggaactccttgtaatggttctccaagggttgtctcgcatttttattaaactctttgctatgttatctgtttctgagaaccccaagaatgtgctcttgttgcagtttccacttattgatagtgtgtacatgcttcatgatctccctgaaggcaaggtttgtccatgcagatccaagggtcttagcagtccttgtggcaaacaggatcaatgaggcctgtgagagtgaatgaatag

SEQ ID NO: 9454 - DNA, 1891 bp, artificial
  synthetic oligonucleotide
tcaactctgtacatactttgaactattctagaaatacaaaaatcctgaagaataaaacttcagtgtttatttgtcccctaatcctctaaagtcaattgctcctgcagaacctcctgttcttgtgattattccaggagaaggagaaatacgacctttggctctcgtagagtggcctgcacaattatctgatactagcaggggaaaaagcggtgaaaagaagcctatccaagtagactacatgccatatgattccagttatacaacattctggaaaagaccaaaccatagtgacagtaaaagatcattggttaccagactttagggaggatgagtaggtggagtatagaggatttttagggtaatgaaactattctgtatgatactataatggtggacacgtgttatacatttttccaaattcacagaatgtacaacaccaagagtgaaccctaacgttaactatagactttgggtgataaagatatgtcagtgtaggtttaccagttgtaacaaaggtatcactttggtgcaaacctcttgataatgggagaagctgttgcagtgggtggacaggggatgtatgggaactctgcactttcatctcaatttttgctgtgaactgaaaactgctctaaaaaataaagtctatttaaaggaaaaaaagcagtgagcagaaaaacatggtcctctcagtaggtattaattcactacacacaatgacctagagccttggccaggatcagctaggtaactggcagggtccagcacaaaataaaaatgcagagccacttggtcaaaaaatttaaaattccaaaatggtggaaacagcattaaatcaaacattgggcctctctaaacaatgggcattcatcacatgctgatgaagttggccctggccttgacatacggttccctgcttaaaacccttcaaagccccctgtaaacagtgaggaagttggaagtccttaattaatttgacatgcccttcatgatatcccaggcccattcccccttcagctttatttctctcagccccaccctactctctatgctctagtcacccagagcttcctttactttctaaaattttccatgctccctttgcctcaaggcctttgtatgtatttcccttacctggaatacaattcctccaatttttcatcactccactattgaccctacaggtctcagttcagcagagaagtcacagctaagtaaatcaatgcttacattatataataaatgctattttaaatatatttaacactattttaaaatgctatttaatttagaaaagaaaaatgcctttctcatgcaataaataaccttctaattcaggggtcatcagctcccccatcacagaccagtactggtatgtggcctgttaggaaccaggcctcacagcaggaggtgagcgttgcgtgagtgaacattaccacctgaactctgccttctatcagatcagtggcattagattctcgtaggaccatggactcttgtgaactgcacattcaagggatttaaggtgcatactccttatgagaatctaatgcctgatgatttgaggtggaacagtttcatcctgaaaccaccccaccacccaccacctatgaaaaaactgtcttccacgaaaccaattcccggtaccaaaaaggttggggatgctgttctaattgcttcatacataaagatctgtatttcacaaagcagttttatataaaataaggcacacctgtagttttcaatattgcttgtcatgttgctagttgtttaagaaggttctgaacacttgctcttgtttacaaaataaaaaacaaagcctgagatgatgcagtcttcttagtaaacacaactttctggagatttcttcattctcttaaaaatgaatgat

SEQ ID NO: 9455 - DNA, 891 bp, artificial
  synthetic oligonucleotide
tctctcctctagcttatgtcttaataatgtgtaaaatccatgtaaggtgataaaaaaccaaagctctgactctaccaccaatgggaacattattggaccactgcgcatttccatcgctgacttctacagaaattgggatgggtggatgtctgcaccatagtggcctctcctaaccacaccccccatcctaattgaggtctcagtagccctgcaccctctgtagcatatactgtttataaacactcttgaaaattccttctgacacctctgtccttcacacttcttcgctcaaatatttctgcttaaaccacccaaggggtctcaggcttcattccacagaggactcaacaggcatttctgttgctgccacagagtcttccctccatggcatttatttttgtcatatttaaaatgttggctgagcagaagcctaggaatgttgtgaaaatgcaaaaagagaaaggctctgagtagaatgcagagcaaaaagatctaaaaataaatttcatgtttacagcaatctcaagtctggagtataagtgaaaagaaatgtgttagaaaccttagaataatgggtcttggatcaagaggaaaaaggagaagggcaggttgagaggatgactttgaaagtgacattaattctcatgagctatgacattaaatttatatctatttaagtcactgacagaattagaaccaagtgtacaaactctaaattacaggaagggcagagaaaacatcagatcaaaaaattactaagtattacatttactaatctacagctgagatttcagaagcaaatgcatgttaaaaatgagatcatggcatgatacctcttctgctcatctgaagaatgaacataatttattttatatgttattgatatgaaag

SEQ ID NO: 9456 - DNA, 1614 bp, artificial
  synthetic oligonucleotide
catttctcatctatttggtatgcacaggcttcactcgtctagttatcaaacaattctctatttgaataattggaaacttaaagtcctctatgtgattttcagtatcttcttgatttgacccacttttactttccaaagttcttgataattactgtacaacaaatcaactgaatctccctaatattgccctcttcacctttgtctatgcattgcacacacacacacacacacacacacacacacacactcatccacacattttacttctgtgtgcttgatcctactatccattcccatgaggctttgaattccaccctcactggtttctcctatctgtaaattctcatagccatatggtctaatacgggatgaaaaatgggttccatctcacagaaaaaccataactgacaatggctgcttggagcacaacgttgaaaaagcgagggtgtacacaggctcagcaacagtatgttgtgatcaattagtaatgtctgtcatggacctgaagtagaatggtggtagccatgccatccaagatagattgtcttacattgctctctgttgacttttcccagttctagtataatttccttaaaagcaggatatgtgtttcatgcagaaggaagaactttcttggaaagtaaaagtatataagtcactaaggtacacataagtttgtgaaatcattcctaaacattttcctaatacatttatcaagaaggaaaagttgcgtcctgaagcaatcattccctaggctctgtgtcaatcacagtgtcatgttagggaacattattttggtttcatcaaaattatcagtttgagtagcagctatacattatatacttactggagcacataactatacctcccccttttttaacaaccaaagctttccctcaataatcttggccaaatttctgcgcttggctaaaaacctataggccatggaaatttataccatttaaaatatgtttttggacatctgcctccttaatgtttcatttttatttatttttcttctaaaacatattttttattaaaagaactagatgtgtcattgtcgtgggcacaaactcatcttgtttattacaaaatgattcatacaaattagtaatgaaagaaatgtccttttcagaaacagtaaacaatttgcacaaaacattccctaaaatttagttgagctttatctcaaaacctcacatgatttatgaaatgttattggtatttctaaaacaaaaagtgaagactaaattactaaaatggagtcaaaagcccccatgaacctctgcattgccagaccaccccccaggggtgtttcacccccaaacgtgatatcccaaatgaaaatcaacaattttcctattaaagttaattggctatgagtagagataggccatcaaggtctcctgtcaatctactgtggctactcctaaccttgtttctgggggaactctctctgctaccatgtttttatttacaaaaacagcgattgagcacttattatatctctgatctaatacttgtcagtcgaaaagttagttactaagtattttttaaaattacattttgtaagtttcctttcattcaaatgttttctcttttatttcttttatt

SEQ ID NO: 9457 - DNA, 815 bp, artificial
  synthetic oligonucleotide
atagtcttcttgcagtaattcctctccaaagagcaaaggtttctccaacttttaggtgtttatataacgactgttttctcacatctttttgctatcttgggctctaggttccctgacttctggttcccagtgttaatgttctcatttttcatctatttcatccttactgcctgaagggactctgatccttgcctctcccaggcactgctggatgcaaatgggaagaggaagcagcggcatggaggtctgcccctggacaagggccatctttacattctgaggcattcagatttgccaagtgtgacttcagctggaaacaatcttgagacagaaagacttactgagccatattctgcagtttaatgagtgtgcacatcagctttcttctcaaagactgattcagatacctaggtctcgtgggtttttttatttgcataattttcttactggaagagtaatactattttctaacagagtctttaggaggatatctgaagaagggagaaaattgtttagtcacatgtagaaacttttctgtgattttataaaatgaaagtacttgaaagggcattgagccacctgaaccactgtttcttcttttcattctatcaataaatatttatggacccttcctttctttggaaggtacttcccaagtcacttggtcatctacctgcttcatccatgggggttccctctccttattgacttgcctactaagctgtactccactgagaataaaatacccttttccaaagtacattttaataatttttcactaaatcccacaacttaagtttcggaagcaaagagaa

SEQ ID NO: 9458 - DNA, 2441 bp, artificial
  synthetic oligonucleotide
agctctatttcatttttaaatagtaaagcagcttgtcacaaagacctatcaacagtctataccaagggtacccaactcctgggctgcagaccagtaccagtccatggcctggtactggtatggttaggaaccgggccacacagcaggaggtaagcagcagaccagcgagcattaccacctgagctccacctcctgtcagatcagcggctgcatgatattctcaaaggagtgtgaaccctattgttaactgtgtatgcaagtgatctaggttgcatactccttataagaatctaactagtgcctgatgatctgaggtggaacaacacttccatcctgaaaccatcccccccacaaccctggtctgtaggaaaattgtcttccacaaaacaggttcctggtgccaaaaaggttggggaccgctggtctacaccttctatacctctctgtccagctcaactcaacgttaagcattttatcagatgtaacgtgtaagacataattcttgtgtgcaatgattttataataatctatagaggatctaggtcttatgtagagtaagacataactgttaaatccagatagtttatgagaagttcctaatgaatcatacatgcaaaactgggtaaagtatttgagccagtgtttgctctcagcccacccagggaagatgagtttctgtaaaaagcatagaaaaataaagagaaagaatttagaactagacaaggaagatcttcagatgctcaaacaacagcaatgaaccaagggcttcagagaagagaagctctgaatagctgctgaggcccaattaggagatggctgagtcaattcaggtgtatgacaacaaaagcactaaccaaggtgaacaatagcagaaggaaaagaaggtaaggaaagaacgctattggaattttaaatgcaaaagaaacaatctgtcttcttcagcttagagcacaggttggcaaatgctttctgcaaaaagccagatatgaaatattttcagcttttaggccagtttctgtagcaacaactcaactctgccactgtagtgcaagagcaggcataaaccatacttaaacaaataggtatggctttgcaccaataaaactttatttacaataacaggcatgtggatcaaatttggctcacaggtcataatttgccaacccctggtttagggaagtccaagatatgaataactgtatggttttgacttagggtgacttgaagaatgatcacaccactgaaatgagtagaaaagccaggaggaggaggtattcaacataacagcatcagtttcatttacccatgctgtgcttgaacactaaaaggagagggctagcagagccaagggattggtgacttgaccatagagaaaagaaggccatagagacaggtagcaggatgcattctgtgaaggtgttggaaatgtaaggtaaaaggtaatcaggaagcatgtgagaaccatgagaatgtgaggaccagacaggtaggaattcgaaaccaggcaccagacaggcatcagaagggcactgaaggtgaaatggaaacaaggtagtgagttaaaccagaaatacgggtggcagacatatcctaagatgacccccctccagtgaatcacacccttatacaatcccttccccttgagtgtgggcagaacctgtgacttactttgtaccaaccgaatacagcaaaagtgatacgattccattcccataattatattccattatataagactccatcttagcaagctgggctaagagactctcccttgctgactttgaggaagtgagttgccatgttgagaggtctggaaaagggacaggaggcaaggaatgagggtggactccaaaagctgagcgtagcccccagccaacagtcagcaagaaaatagggaccttgatcttacaaccacaaagaaatgaattctgctaacaatcacatgagttggaagttgaactgaagccccagagagaaatgcagctcagctgacacattgattgcagccttgtgggacccctgagcagacgacccagttaagctgtgcttggactcctgacctatggaaactgtgagataataaaggtgtatggtaagcctctaagtttgtggtaatttgttatgcagcaatagaaaactaatactattaggaaaatggtgtcccagatggtgctgtgatttcaaactgcaattcgtttccaggtctccttctatttgccagtttatggctattcacagtttttggaaatcccaagcctagaaatgcctcaattattaccagctttatacattttcttgtcacttttcaaataatgggtgggaggtaggaggaaaccatgctagaattattttacttaaacacgaatttgacttcactttggacaataagacccaatcatagtatatcaacattgaaacatcagataaaaacttaaccattt

SEQ ID NO: 9459 - DNA, 1120 bp, artificial
  synthetic oligonucleotide
actgataaatgctttgactgacatctttgcctacattcgatctgtttcatttcatacaccgaaaatcttctgaaatgggtaatctgcccacaagcaccacagggaattcctcaacagctttagcatccgtaatattactccaaaatagcattgctgttctgcctcttactttaaggttgggcagatgccaaaagctgcaaacccatggaaccatccatgaccgggtacacttaccagatttgtttccttctcttaaattaacacaaataggcctacgatgctaattccggagccacgttcaaatttcactgtttcatcaatcatttcgtgagctcattagttgattaacacttttttggtggtgattaaattagtgtacatgcacactcatgtgatcgtgtaatcacttaaaacacagccaggcacatagaagctctgtatcaatgtttgctattattacacaagtacagagcttctctcaggttgtatgatgggatctttgtcctcaaaatcattcttcctgccaaagggcttacaacagtttttctgacctatttcaattaaaaagaaattgtttctatcttgcctttacttctactacttcttactagcactttcttctttcaagtcctctgaggttatcacataagatggggttcctggcaaaattcctcaacacctagcagaaagacagcaaatattccatagactgaaaaatgagaaattctttttaaaaagggcagaaaataaaagaggtcccagaacctcttgacgcatattttggtggtgaagagagagccagagggctttgctccagagtatggttttgtttgtatctctgaaagtgcacgagttgaaattccataaatagaggagcttctgtaccactttctattgctaatattttcttttcctctgacgtctgtcctcagcatttcagttcatggtgagtgcttaataaatgcatgatgacaacagatgttagaaagtgttacgagagcacagagcattctagaaaaacctaggaaaacaccagtgggggaaaacatcattatttaataaatttatgaaaactttaaaaggaaagcatgttgcttttcaaccaaggactttctaacag

SEQ ID NO: 9460 - DNA, 3421 bp, artificial
  synthetic oligonucleotide
aatcagacagcctaattaaatgacaattttaaaatatttttgtaatatatttacataattgaggcaataaccattcattgaatgaatagatttttttaaaattaaggagcccgttctcacctttcctcccccacccgcactcttgcaaatggcaaagacctcagatcatgaatcaaagggtaccagcacacagttcaaaaaggtggtggggtggagatgttgaatgggcacaatgagcacagactctacttccttcagtgtaaagcaacctctgttgaaaagtggttaccctttaaactactttaaaaggcaaatcactgagccaccggtgtctccaagacagatgaacgagcattagtaacttacaagtatctcatttggtgtttcaagacaagtaactatagaaaaaccagagaaagagctgttacaggttcctggaacgtttgcctgggaaggtatcttaacaatttcctaattcaggtcttcatttttccagtggaggaaagcgaagtgtacgaggtgtgcaatttgcccaatggccctgcaattaatccaggagccccgaggtgacaccaggaaccaactggagcagctccgggatgcctgagtccaccacccctgtccacctctactcctttcttcaaaaaaacaattttttttttttttatgttggggactggattttggaagacacgaattccagacagttaactgtctttgcctgattataaatattaatgattcttgtcaactctctgcctgcttctctccaatttttaaagttggcagtcagaacgtccagtctcaacagtgcaaatcaattcaaggaaaactcagtaaattagcagatgacagaacaactgcagtgtctcatctcaaaacgacacatctcacacgtggaaaatcaatgtctgaagactggaataaggtaaaccttctccctgcccccttcctggagggggcatttgaaatcttcagaagtagtagtcattcctcagaaacaactttccttttttccttctttcctttcttttctctctctcaaagaatatactcatctagtatctggatttggtcggtcgttaaccttaaaatcttgactccttcttcaaagaaggcaaatcccatgagctttctctctgttgtgtttcctgcagtacctgcagcacctagcgcagtccctggcacacagtaggtccccagtaaatctttgtatcaacagggagaacagaagccaccataagggagggggaaggtacgacagaagagcccctggtattctcttgtattagcgtgcaacattaatgataatgtgcaacattctgtcccgccacaaagtaggagggaaatgcactccctttctaaggagtgaaacggctgcaccccaacgctcccggcagcatttcttcagcaaatccactcgccgcacactgagatcatgaagcggccctgcctcctgtccagtcttattctcgtcctttcaacatatctgactgaaggctgaatgagcgacctaggcctaaccccaggaaccccatttgtcagcctttgtcagcgaggtggtggcggagtccagccccgtcccagatgcagtgaccacagcgttggggcaaagaaacactgaattcagggttggggctcccctgtaccttctaaaagatttcgggaagcgccactgagttagtgagcaggtggcacttcggggtgacgtacccggccacccgccaccccctcagccgtggacctgtggggagccccgactaccatcgcccctcgcagtccccacccggagcggcccagtggcgccccctgtgtcctctgcacgcgtcaggacactcaccgcgtagtgcagctggggcttctcgccgcggtacaccgggtgccccatgtcgcctccgggaggagtggcgcgccttgggctcagcctggggtcacggtgtctctctgagttccccgcacttcactgccatcctggggcagcccctgggcgcgagccctgctccgtgcgtgccgagtgctgtgcaaagcgcccctggcacagcgtcccgctgccgctgcggagccggtggggacctggagaaggcagcggcgcgaagggggagggggaagaggaggaggaggaggaggaggaggaggaggaggaggaggaggaggagggagcggccgagtctgatgcgatgggcgggcgtttaattccttccgctcctggcgggtccctccggcggccgccgccgctgacagctgttgggggctgcggaggccgaacgcgcccacgacaggtgtcaggctggccggcacgcctgcctcctgccaccccaccctccccggacccgtgggaccccggctgctgaggcggggactgccaaagcctttaatgccagcgagaaggcgaacttgggtttccaagaaagagagactttcactaactttgaaggaggtgtgggcctgacagtggaaggagattcagagccttctcctgggagggcagagtttccctttctagaaagccttcttctgtgagagtctcaaattgtggggacccttggggagggcaggactgagaggaaccaagtcatgctacccaggagaactgctgcggggacaaggctgcccaggatgctggtcacttagggtgacccgagttccaggggggcttgcagggcacattctgtaggttcacaataacccttaaaactggcctctgctctgaaatcccctcatggaaacctgcactttaaaacaccttggagaagatcagcgagttccctccacagccttgtccttctgtaatttacgtccagcctcccacaagttgagcccagaggaaggccaggcctggggccagagtagagactccagactcatgaatcaatcaatgcaagccccagaggggtggctacaaagtggaagatgtgcttgggggtagcttgtgccagtttgtcagggtcccactgtactgaaccggctgaatgactctccacttgctctgtgtaagaggagaggggaggagaggggaggaaagttggatgtggccccggaatttcagcccttacaatttagttgaatgaaccatccactggcatgtaatattttaaaacaatcacagcataattataattagcagtgggaatgtgaagccaggggtgcaagtggcctgaggaatctaccattagatagtcccatgacagtttatccacctggaaaactggatggttatatctgctaaagtcaatcataggcctaccttccaatccagcaaattccacccctagatatacagagtacaataatctcatcatataccagaatgctcatactgtgttgaggcataattgccccaaataaaagcgatccaaatgtacaccaactgatgcatgacaaaccaactgtagtctgtgcacatgatggaatactattcagc

SEQ ID NO: 9461 - DNA, 1897 bp, artificial
  synthetic oligonucleotide
gtctctcttgggagtagattcatgatattattcagtcttcgatgggcagaaaaccatacaaattggatcaaatcgttcatactatgcaccagtgatgctctgaatatatactataaaatcaatattctttctattcttttgcctctcaataaccaattttaataagtggaaaataattcagattcctctgacaatagcctctttagaaagaatggggaaaattcttgggttacaattgtgtcaatgaaagggattctttattttaaaaaagataaaaatatccaaagcaaataagaacaaatgttaacagttactaaatctgagtaacaaatacatagatacttgttttcgtttttctatatttttctttgaagtatctgattcaaactcaaagaggatgctaaaatcagtttgaacaaagcaccagtgaatacttcaaagaaaaataaagaaaaaagcacgtttttcttggtgccaggtgactatgtagaccccatggggatggggaggccagctgggggccaaggggctgcatcccacagtgtctacctcagtttatattgccaccttacgcaggcagggcacgttagcctttgatattcaagagcagttctaactgagcagttcagctagggtgtaaggaaatcttagtagttgaatttttttttcatgtgctctaacagcttttaaaacaaggaaattattatcaatatctgcttctactctccctaatgagttgcaaaagtgtgtaacccctgcctttctctctaatagaaccaatatggtagcaatggggacattttacacaaaagtcagagtgaaaagatggacttttaggcacattttttttttttaagagatgagggtttctctatgctgcccaggctggacacaaactcctggggcacaagtgatcctcccacctcagtctctcaagtagctgggattacaggcgtgcaccaccatgctcagtttaggcatatattataaaagaagcaatttgcctgaagcactacactcccctgtagactgtggacagataagtaagcaaaacaatttttctcccagagtaggagttggcaaactacagcccctgggacaaatccagtccactgtctgtttctgtgaatacagtattaatttaacacagcccagtccattcgtttgcatattatctatggcttctttcagctacaacatcagagttgagtagttgtgacaaaatctgtatagcctcaaaagcctgaaatacttaccatctgtcccattacagaaaagttccctaactcccatcctagggtattaacatatgaatttgttccatagagccactgtaatcccagcactttgggaggcggagaggggaggatggctggagcccaggagtttgagaccagcctgggtaacatggcaaaactctgtctctacaaaaattagccaggcatgctggtgggtgcctatagtgccagctactggggaggctgaggtgggaggatcacttgaacccaggaggtggaggtttcagtaagctgagatcatgccactgcactgtagcttgggtgacacagtgagaccctgtctcaagaagaaagaaaagaaagaaagaaagaaagaaagaaagaaagaaagagagaaagaaaagaaaagaaagatttaataacaagtggacaaaataaaaaataatatttctcaatgacttttatagtcacacagtagtatacatttatactacatttttgctttaatacagaaaaaacaattataaagacccaaatattgtcaccttttctcttgaaaaacaaacaaacaaacaaacaaacaaacaaacaaactagtgtgctctacaaaggaaacctaaaagaggatgtgttgataattaataatgtaacacattgtt

SEQ ID NO: 9462 - DNA, 617 bp, artificial
  synthetic oligonucleotide
aaaaactactaatctatgtatgtctccactgaacctcagcaggaaagttgaacttactttggtatattttacccaataaacaggaataaaaatgcttgtttttacattactgtcctacctcttttaacacagatgtaccattttcactcctgacagttaccagttaattataatccaaacaacacactcttcaactgcatataatttcccttgttgaaaattgttccacctgatatttagcaaatgcctacggacttttcaaattacaagctgtatgaactcttgctgtgaatgtttatattattaaaatatttcctactcatgatttaaaagggctctctcactttaaaaaatcgtgtgtttttttttgtcttggattttatgttgaaccttttttccccctaagaatgaacattggatatacccagggcctatgcaagtagcactatcacttactcatctctcttgctgaacatgagtgagaaatatcatactccaaacttctcgtatttcccctgcatttgttgcattcacagattatttaaaagaaataaatttaaacctcggctacccagagattttcaaggagtccctagataactactgtgttttggcga

SEQ ID NO: 9463 - DNA, 970 bp, artificial
  synthetic oligonucleotide
agaggcactagctcactagagcgtgactgaaaagagccagaagattctggtttttgttagtcttgccttgtagtcaggaagacacaatagcagcgtctgtgtcacagataatggtaatagcaaaggggtgtatccacaataggttacttgaggtccagacctagcttaaaagtcaaaatatttaggccaggcatggtggctcacatctggaatcccagcactttgggaggctgagatgggaggactgcttgagtccaggatttcgaggctgcagtcaagacatgattgtaccactgcactccagcctgggcgacagagcaagaccttgtctcaaaaaaaaaaaaaaaaaaaatcaaaatttttttcggagcagttctgtgaataccatttgacccagcaattctaatatctactttatagcaatacttgcaaaatgtgcaagatacatttgcaaagacattcacttcagtacaatatctgatagcaaaaaaacccagtcaccaataaaaacaacggaaatgtgagcatatgttcaccaaaatatgtgtgctagaatgttcatagcagcattattcaaaacagccccgaactgtaaattatccaaatgttcgtgaaagtagactgaataaattgtggtatatcacataatggaaaactatgcagtaatgggaatgaaaaaacaaactccaaccacctacaacaatacagatgaatcccagagacatcacgttgagcgaaagaagtctgacataaaaaataacatgctgtaggataccagtaatgtaatctataaaaccagataaaaccaatatatgctacaaaaatacagaataggggttacctttggggagaagtgactggaagggagtccaagggatccctgtgaggtgctggtcagggatggttctccatctggcacaggtgtgttcactttgcagaaattcattaagttgtaaacttatgtgcactt

SEQ ID NO: 9464 - DNA, 1288 bp, artificial
  synthetic oligonucleotide
agttacatcatagtaaaacctattccccatgtgctcagtttaggaagcacattaataaaacaaagtagctatttttaaaattacttaattttaaaattacttttgacacagaaattttctgaagttctgaaagttttaaaaacacttttggttgccaagaaatataactaagagaaattaaggacttggaattattctgtatgaaaatatgttttctgatcagtgtcaatcttgaattagttcccatatgtaaatcaaaagtcacatgggcactgcctaagtggcatgaggaacataggagtgtcacaagatctgctgtatatcaaggcaattaaataacatacaggatatgattcattctgatgaaatcaattaatatggtagcatatcaaccatttatgaatcactattgggagagcaattcgattctaaaaggctgcttctatttatttttagatgacctaactcaagagatcatttagagtttcctgttttccttcttttactcttggattcaaatgatcgtttttcacatgtgcagctgttacaaatccaaatgctaatacgcaactggaaggaaataatgtgaatagattacatctgtgccagaccggcaccccgtcctcctcacaccctggttcccaggatatccatgtaatgactctcagtgttgacatggacagggctttatgttctgaaaagatgccatgtaattaaccttcacttaagcctaggttagtttgtttttaaacattaaagctacttaaaatttttttgttttgttttgccatgaagcctgatatttctccccttagttgggtgggtgatatgtcttttctttggaaccaccaggatctgccttccttttcccacttagctaccttcgaggcactatagaacatttcagagttttcactgagcctatgtaaatatgatttagtttaaaaaatctataatggcccagtatgtattgttcgattacttccctagcccttccttccatgttaattcaaattcttgcttcctgctgctttgtatatataatacatgcaagcaaacatacatctccttctgttgagggaacatctcatcattctgttgagggaacctcctgcaaaaatgctcattctgcttagtctagccaaatggacactttctgaaaaatcacctaaagtccacattagatgtatttgaatcccaatatcaatatcatcatcctagaataaaccaagtttaaaagagaatacattactaataccaacctgagtgatccctttaatatgctcta

SEQ ID NO: 9465 - DNA, 1513 bp, artificial
  synthetic oligonucleotide
ggggcttgaatccaggccttactttcaacagaatttggtcctatttgaatcagaatttggcctgataatgaatggcccagacacagattttttaaagtagatctgaaaggataatccaattaaaaggtcttccctgctaagctggaaatggagtgaagctgaatttagctgtgctatcaacgtaatgacctgggaaagaaggaggttgaacaacatggaattccttttcaccaaatttttctaaataatataactttttaagtatctgcaataatcatgagtgaaaattaatttatcaagttcaacaccaatatacaggaataacttaacatgtgttactgtttataagacaccatcgattaagacatgccattattttatttatttgtttatttatttattattatgagacagagtctcactctgtcacccaggctggagtgcagtggtgcagtctcggctcactgcaacttccacctccccagttcaagcgattctcccatctcagcctcacgagtagctgggattacaggcacctgtcactacgcctggctaatttttgtatttttagtagagagggggtttagccatgttggccaggttggtctcgaactcctgacctcaggtgatctgcccgcctcggcatcccaaagtgctggggttacaggtacgggattacgttaggagcttatcattggttataagattagtctcaatttcagagatcataggtcatgggagaaacgtatcttagaattgctgaaatttagtaggttaaaagtataacaaaagtgataattttgtaagagcatagcaacaacttttcctgtcacaaatttattgtttggtgtcctggtgatgatactactcctggttaatgatgctatattatgcccttaactggttatgccaaatgctcagcatccccacaccctctgcctctgcagcaaagattggaagtaaccataaaatctgactaatgcaaaaactctgtgctcctcttttgggagcaaaaatggcagcaagccatagcctgcagcatggcttgcattttactaattgcaaacatgagtgcatgtagaaacccatgtgcatttttatcaaaataatactagctataaaaagtgggagagccaagaaggtgcacacctctaatttcaaatgggcacctaggcctcagctaaggtctgtcttgtggtttgataatgggttaatcccactggtaaagctgcacaagcaagatgcatccaggcgcagccttaagggcccctatgcacgcttatcagaattctagaagtagaatcattgacgtgtattatagtcccttgccagtaatttgtgctttttccctgtaaatgaagtcaaaaggaccctgagaggctagagaaagctgaaaataaaacagaaaaatcttgtaatgtggtttctaatttggtaagtggattgatgggacccgaagcattttctggttagatggactgatcagaattgccaaagagttgccaaaattcca

SEQ ID NO: 9466 - DNA, 2137 bp, artificial
  synthetic oligonucleotide
ccctaagaagatagttttgagttcagggtcccaaataaaggcattaaaatactcatgtatctatttacatgaaatttttactctgatcagtgattcactagatgaggaatagtctaaaagcacatagtgacatctctttgtatgtcttggagtttgatggattgaggttcagaatgttgggtgaatgagttgccagttgacataagttggcatccaaaagtgcctggtggcttctctttccagtctcagagcatcatggattgaggttgggtggacaggtcaccagtctacatgggtttgcctccatgcatggagggtttccccgttagacccccaaaccccaggaccatctacatacagcatgcatggccaatctcagctaaccagacaagcaagggatgggcatggagagcgagtcacattctcacccttagctggtccctccaggtcagggcgtaaacatgctggcagggtactgtgggcaggcctgcactgcagccggaagcacagaacttgttctggggacaaatggaaaactccggttcaatcaccggatggggcccgcccagcaccttgctgagctaccccagcaagaagaactgtggaggtttcaaatgtgtgttggcttcatccttggcttaatcatatgactgataagttccagtctgttggaactgaaagcattgtatcatccatcttggattatatcaatggtactgggaaaggaatccactgctggagcagctttggaatcatgaagaatgtgcacattaatcaccatcagttctacaaagcctccctttgacagattgctagggataaaggtaccccacttcaaagaggaactgacatggctctaaactctccactggatgatgaagctaacaccctgggcataagcctttggtgaaatttttcccctcatttttagtccttattaattccctcctaatgtctctggcaaatggagcacttatgacaggtgaagatcagacagtgttgttttcattatttacagagggcctgataaaaacatcttcaaattaacattctgcaaatttataaagaagctgtgaatcatagtgaaggtgtgaggaaggaaggggtaatgtgatacattctccctccatcttgaatgcctttccatagaaggcatatatgcacacattttagaatttttcattatggaattctctattccacataagctttttctaaaactatctggctggaaagactttcttgaatggagtatgtgtgttgggggaggggggcaggggcagttaatgcttcataatttccagggtattgaggccaacagctaccgccactcaataggactctttgctgttacattgtactggtaaagttagatttcttgtctgaaaatttcctgaaaccctttctgatatgaaaaatcctagtaaaagaaaaacagaaattataatctgtcacataacactccatgtttgtgaaaaaagatatttttaatgatgagctttgaaagattaaaagaaatgatctatgtgatatttggtaagttaaatgtgatacctttaaattagaagaaagcctaatgctcccccagaatgaagaaggcagatttgtcattcaataagatgaacatctagctaaacaatacaattatttttcagtactgaaattttattttttttcagactagtacagatcttcaaccatgctcttgatacactagtcaccagttttgctaatttttaaaattaattttagtttaattttttttccagtaaaaactttgtgaaggctactaatagaattaaccacaatgaaatttaaatatatatacctgagtttagttcatccatatctgccttctctccaaatgcagttaaatttgttctattttgatcttgtttccagagtatagaagggaagatactttacttagccttatttaattaatattctatttctggggagcccctgaggtttgatagaataagagcaaatctttatatgtttcctcaagcctatatttaaaaattacaagacctgttgctgaaactagttactgtgtcacagatgatctgagctctgctgagctctcctgagctctggatttatgggggattttcacattaatcatgcttagttc

SEQ ID NO: 9467 - DNA, 1730 bp, artificial
  synthetic oligonucleotide
atttgcaattctccagtcatcaccaggtgatgtgtgatagtccagttcaggtctccctaactgccggggtacctaagagagcccaacgcctcacctgctcaagtcacccacttctgggcagtttcctggctcaaaggaggcaaacagcctacagtcggaagttccaaggaggggaagagatccacccatgcttctgtattctcatatacactcctcccacctgtgactctcattttttaacctttaaatctggtccctggtccacttgagtggtataaagtctaactctgtctctcccactcactgtgaaatccaatagattttacagagaatatcttcattcaaattacacctaaaaggcatgtattaactctctttgatctaagctggatagtggagttgattacaggctggggttcatggatttagattctgcatgaacacattttgctttgtaccaagaaaaagcctatttcaggacttcaaagtctaactcctcctggccagccagttctcaatgtgtgctggtggtcaagggcaaggatagtttgtgtgatgtttcagtgcaatccctccctcattcctaagaaaccaaaacagaaaaattttcccttaatgatagacttactgggcaagagataatgagattcttctttatttaaaaaaatggtcaaaatgttagtatcatctgaataagcttagtcaataaaactccccaaatacccaggctagaatgcccatttcgaaattatctccctatcccacatgcaggtgtacacacacacacacacacacacacacacacacacttttttcttaacctcaatgcaataaagatctggggatattgagtatcaagatctttggaatgtcagagtaaggcaccagaattcttgtttgcatgaggactttctagaggtcagtgttcctctaactctcttaatgataagaagcatcaatgacacttgttaaaaatacagcttctcaagtgcctctcctggaaattctaactcagtggaagggagctatgctccgtccctgggaaagctttagaaaaaatacagatttctaggtccccaacccaaacacactgaacctgaatttctaggaatgggcccaggaaactgtggttgtaaaaagttccttgggatattaaacaaaaattagtcagctttggggtttgctaggagaaatagtcaagattttaggactgattgtcagattctaagactaaggttttttgttgttgttgttgttgttttgttgttttgtttttgttttgttttgttttgcttgagacagggttttgctcttgtcgcccaggctagagtgcagtggcgagatcttggctcgcgacaacctctgcctcccaagttcaagcaattctcctgcctcagcctcccgagtagctgggactataggcacgcaccactacacctgtctaattttttgtattttttagtagagacggggtttcaccatgttttggacaggctagtcttgaactcctgacctcaggtgatccgcccgcctcagcctcccaaagtgctgggattacaggcgtgagccacagcacccgacccagattctaagaataagattcttaagcaaagagtcttaaagccagagtcaatctcaagggaaggttgatgtgtgtttctgagcaaacaggaaattaccatgaagtagaaagacggagaaaatgcattggcccaccaaggttcactctc

SEQ ID NO: 9468 - DNA, 1768 bp, artificial
  synthetic oligonucleotide
tgtgaccatctcattagggcctcattatttttcacatggactatggtatcagctttcaaactggtcttcccactatgagcaattcttcattcatgcctcctcccaataccaccagggttcttgcttgaaaatagagacatcaaaatgtctgtcagtctttcaattaaaactttcccaaaggttccccattgcttatggagtaaagtctagataatttagaactatatcctagtttgtccccaaatctgatattaacttttcttaatctcatctccttatattactccctacctaactaccaatggtcacgtcaaaaccatccctatcacactctaacttagcctacttccttaatttcttcttttctttgcacaccctcttctttctgccttggccaaaccataaatacctacatatttctatcagtcgaggtcctcaagtccaaactatactcattctagcaaaaggacatttattataggatactggtagttcacaaaacatattgagcggtatgaagaagcttacaaagttcccagaagagtcagggacttttgtgtactcagatgccaagaacaatacccaaataccctagcctcctctttctgactcaacatcacagatttccccacccctgcattgctcacactaaagctctacttctgtctccaaaaggcaaacccacacacctaccacttccattgctcacctatatatcaatgtctcctgtttacccctctgactgctggaatctaggtaataggcaagtgtttagctccaagtgagtctggtgaagaaaggtttttgccttctatattggggatgcaagaagtttcccaaccattacaagagtgtttaaacggtctaggcagctagagaatctggcaactacccacaacatccttcctctttgatggccagatttatatttcccttccaaaactaatcaccagattccttcaggcaattggctctcaatctcatgaggcatacccctgccatggccctcagcatgctgtactggaattatgcatttgcatttccctcacttataaattccaaaaaaatccttgagcatcatgggtatgcctgatctttctttacattattctcttctccttatttaacatatagccaatgtctggcagatggcaagcacttaataaattttctttttggaaaaagtgagtaaaaattggagtcataattcaaatgttctttatctgcaaatattttagtgatatacctttagctgaattcttttacttaatattcccaattcaagggaagattttcaactctgctgcaataatatagcattttaatacacaaagtgtttaaccaatactaaaacccttttaaatagtatgtggttttctaatatgccctagcaaagctggaactctagcatgagtgttcccaaagcttaacaaaacacaagcaatttgaattcaggattccatgatgtcattaacaaagatgtgactttgaaacggaaacagaatagtggggaagatttctgagaggagacttcaactgtaaaagtcattttaaatgaattctatttgtttcgttaataatcatgggatttgcattgatgttacattgcctttactttaaagcagtctccatggatctgctgacagcttcatgagctgattgtgacaacagtctatgtccaatgaaaagaaatgggcaagtagggagtacgtatttttataagtgaacataaagagaacaatgaatatgcaagttccctttctacctt

SEQ ID NO: 9469 - DNA, 1509 bp, artificial
  synthetic oligonucleotide
tgttctgattagctaagtaaactggaatcagaagccacctctggagcttatagtccacaggtaggtaatcatcattcagttgaggtgactccctcagccctagagaggtttgcttttctctcttggtgctctcagtagtgtggcatgtgccatatatattgtactgaaactgtgctgacactcctgaggcgaagggtatagcttgagctctccaagaaagagatgaggcaatgatgtgtggtcaggtattactgaaaatatttcaaaggcaaagaaaacagaaatggagggatggctactgtcccttgagccaattcattatcccactggtactggcccttatgatcctgctttttgagtggcaccgaacggtgagttatcatgtgtcttgaagagttgagagaatgtgtgatgagtaagaaaaacggagttcaggagcagttcaatgttgagaacacaggtggtgactatgttccctttggattctggagccactaagtgtaacagagtaggtttcagagaatcaaagatcatggatgttttacaaaggctctgtgcttcagttaaaagacagttcaatttgttagagaaataatggccagcttcacacaaatagtggaaaaagaacaaattcaggaggaggagtttaaaagaattttaaagagcactttcggtggaatactaaaggaatagcagctataggtcatagacttttattcctggaataaacctttgagatcatttaatccaacatcattatttacagattaataaacgcacatcttgtgaataacagcatgcggaaagagcttttaaaatcaggagttattgtactaaagagagagaaggagtccagaaatggacacgcagactgtggcgtcatctaagtacaagtagtaattgaactcatctatgatgatacagagggaagagatccatttcagcttccaagcaaaacatatagacagtgacacacccataatgaaatggccaaatggataccacccaaacatagataactatatggcccaaacaatgtgaataaattgaggaaattggatggctatatttcacattttttggcgtatcaagtgaactttaattactttttgctcctgggataaatttttctatctctcaaagattcttaaggaaagaaaggcagattcaaaatttgcagtgtttttgggaggccgaggtaggcagatcacttgaggccaggagttgaagaccagcctagccaacatggtgaatccactctactaaaaatacaaaaattagctaggcacacctgtagtcccagctactcggggtatgagaattgcttgaacccaggaggcagaggttgcagtgagctgagatcccgccactgcacttcagcttgggcaacagagcgagactcagtctcaaaaataaataaataataaataaataaatattttttaaaaattgtacaatgtgataccatttggccaaaacatataaatacataaagaaaaaagagtataa

SEQ ID NO: 9470 - DNA, 506 bp, artificial
  synthetic oligonucleotide
aaaatactgtgtttccacccattttagtcagggcccataaatagagtatgtgtacatatgtgtgctgtgtaccctttaagtatacaaatgtcacttagtcatcttgcacttctataattgtgctcactgaatgtgttgcttccttaataataactgtaggctagggtgattgattgatttgcaagtgtattcactctccagtagtaaaccctgcaagcaacttttgagtaattatggggtaagggagggaataagtcaaagctttaaaatcaccttcaaaacatgcagttatttctcctatctcccaatttttctccagatagtgacacatttctcaacttccttttacaaggagactccttccaagtgttgtttctatttcctctttccactttcctgcctcccagtcttgtgaacctcctcttttcaagccattgcagccaccaaagctgttctaatgaaggatcactagttacttcaacattactacatctaacattagttct

SEQ ID NO: 9471 - DNA, 1571 bp, artificial
  synthetic oligonucleotide
gaagcaagcagagagagagtggtaagactcaccagcttccccatttttcccaggatgggggtttttgttcctcagttctgatctggaagagacaaacctgtaggtccttcaagcaggctgggctggggcaagtgccggctctttgcctcggatcagctgaatggctggggcgttcaggaagcttgctctgtccagctcggaatcactccccctctccagggtgtgtgcttacacgcctctcagtcagcgcaaaaatccgccaaactcaggtcagcctaacaggtttccttatataggtaaacatgaattgcattcctggtgaaagaagttaactaggaatcctggtaacctggttaactctatacacaccagaatggctcagagttgatcagcctgcgtaggggtttggttgcagtacaaagggatttgtgcaatttaattaaaatcatctttatcctggcagtctgtaaaattggcccttgtagtgtgactgtgagtcaacagttagtattttatatcatgggctgtgaccagcctcatattatctgaaggcattgtaggggaaaaaagtgtaacattttataagttgtctttcatgtttttaaaaccagggtaattgaacttgagattattttcaaagaagtgaatagaacatgtgacagaaagagaatgtgaataaacctccatcaaataaggctcaaatccttatttgagcatagtaacgaatagttattcaactttcccaggcctttggtagataatgcaatacaatcattttgcgttttctccctttacaatgcagtaattgctactgtattttttgatgggcaaaatgacagataatgacatctattccaataacaaccctcctaagcccacatgctgatgtgttatttgatggtttcaggaaagaaatctaagacttgcgaatttgcatacttgtatgtaaacatttttaaacaacttcctcgatttaagaagataagaaaatatatcttcaaaagaactctatagctcttccccttacattttatctactacttagtaaagtaataattttaaaaaattctagccaattccactgaagacaatatggagacttgagactttcctgtgtactagagatgaagattgtctgctaaaaaggacctatctcaaaatgaaacacttgtttttatttcatccatgggttgactgctccttgagtagtgacaaccttattaaaaacagctcaaggctgttttaggtctctgtttaggacaggcgagataatgaatcttctgatgccacctaagtgagcaccaacacaaaccaatgtcaaaaagtttctgccgagatgagtaaggaacaaaaattgcactgccaggaagggtaactatttttgaatagcaatttccactgggaaaaacttttgcatacaatttctcttcttatctctgcaggaacactgtgaagtgtgtagtatttcctcttcacaataataaagttggcttacagagataaagtgattggtccaaagtctcatgatcagtttttggcaaatccaaaaccccagataaagaatttaactc

SEQ ID NO: 9472 - DNA, 1721 bp, artificial
  synthetic oligonucleotide
taaatgaaattaatttgtattgtaacttatctcccttatgcatacccatctatttgtaacttgagaaagactatattcttaattgttgcattgcaattgttaaatttattgcaaccgaagacatcacatttctctattgcatatttttatctccccagtcatgagacagtggatgtcctttatcctcacctccccctaattgtttccctttggtacacactctttccttccttcaattttcataaattcaatagtcaggacccagagagagcaagaaacaaatagatgctatgtggaataaaaccattacttcctgacacctccatatttgttctttctggtctcttggagtctcccaattagttcttgtcttaattttctggcaaatttcaggaaccctcacaatcttcaaactatcatcttccaatattcttctcttgggaattccctggaaacttcctgccaatatgcaatcctaggacctgagtaagagccatattttattgactatgagagtaatcttccagatggcttattttgtaacattccgcaagctataggactcagtacgtataggcatgtctccccaagcctttctaatcagtgggctaaggagagacattgttctattcattataccatatgccaatcccttctcaaatctgggatcataattgatgggttttcttttttccataggccaagcttttgtttcatggctctcatgttcttgagcagccccattggcctcaagccctcacttaccctaacagttagataatatcacccatcaaggagtcctaaaatgcagtccattgacattaaagtgatagtctttgctgtcctaaagcttatctgtgctggacacatgcacagcctggagggcaaatggattgttcagcagcttgccagggagagataaataagcagtgaaggaaagagcagaccctggcagggcaaaccgaactgggcaaatccataaagctacagccagtgagcaaacaacagcagtcttatattcagtcactggaaatgtgaagtttcttttgacctaatgtgttaatgtgaatctatgattcacacagtcccgaaagacaacacattttgcagcaggccgaggaacttttgttataatgtcatctatggaaaagatcaggaaagcagaaaatatgatctttataatgtttgtgtacctacagggccaattatctattaaacaatcatatagagtgatcatttcagggaaacactaaaagagactttaaaaatagtcagtagattccagtgatttacgtcataaagaaacagaccatcttaagtaacacatggacataaaagcaagcagatgtttgcattctaaccagggcactaatggaggtgctgtggcattgtatcaaagtaaagtttgccatcttcagaattgcccactggagttttaaatacagctgtataactttgagtcaacaacttgtaagcattccccgaccactctgagcatcattctttgctgcaggtaagaattaataattcatcactaacacaccgtgtcaaactcattttctgaaacaggcctgaaatgtgtgattgactataacatgaaaatttgtcataaaaacaattccttgggttgctgaattgtaaacataagttattatgagcaaaatcacagtaaaaataaatgagcaagaccaaactcacaagagactggatttgaaatttca

SEQ ID NO: 9473 - DNA, 53601 bp, artificial
  synthetic oligonucleotide
  misc_feature (800)..(50799): n is a, c, g, or t
tgtttctacttgttggtttcatgtttcaattcattgtggcatcagggcaaacggatttttgtgtaagctcttagctgagatgatactgctgagcttttgactgtcctgccatttccctccatgaattggcaggaaaaatatttatattttaatcaaatacaaatacacatgaaacagtctttttaggagtttcttttcctgtgtaatgaagtgaaatgaggggaaacgctgaactgactaatcagattcgccactccaaagaagctcaaatgtcatctctatggcaacatgtcagccagggtccgccctcatctcttccctcagactgcaaactgcacgttgccactgctacatgaattaatgtggagaacacactaaaaacagtgagatttggcttatgaagaaggatcttaaggttgatcccattcatgtaacactctatcctgtttttaattttctttcttcaaattgaattagtctttgaggacctgcttcacacaatggcttcactcactggctcctcactctgtgtttcagagggatgccaagttgttgagtcctttgttctgggaggggactgaggtcatttgcactttggaccccaaattgggcaaatctcagagaggtgatgcaatgcagaaggtgagtccagtgtatataccagggaactaattttaccatcttaagaaggcatgcaaaagtttatctattcattggaagatcacctattgaaaaatatgttatagttttctgactaaactcatcacaggctagtgtttacgtaggtagtccattagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcacctattgaaaaatatgttatagttttctgactaaactcatcaaggctagtgtttacgtaggtagtcaattagttttaagacccaggagaaatgtccctttcatcaatcatgtgcctcatattcgtgttccttatgagggaaattaatctgcacagctcctctaaattcttcattttattataattagctatttatttttatctgttcttaaaattgtggaaagtggctcagaactatcttccttaagattctttttatacttggctgggtgcggtggctcacgcctgtaaatcccagcactttgggaggctgaggcgggtggatcacgaggtcaggaggtcgagaccatcctggctaacacggtgaaaccctgtctctactaaaaatacaaaaaaattagccgggcgtggtggcgggcgcctgtaatcccagctactcgggaggctgaggcaggagaatggcgtgaacccgggaggcggagcttgcagtgagccgagatcgagccactgcactccagctgggtgagagagagactctgtctcaagaaaaaaaaaaaaaaaagattctttttatacttgaaagccttagagtaggatttctacctagctttcaggcaaggaagccaattggacaaaagcaaatgttgcaagaagccaaattcactgagtctacctattgtaggtttaattgttttaagtggaatgttgtattttagtgactaatatatagtttctcaaaataaggtaaattaagagtaggcagaagaatcctaaaaatgctaaaagtctggcaaaagagaagtataaacttctcatatggaaaactatttttgcatcccctcaaattggtatttatatgtaacaggattttttcaatttcttctgttgctgtctggatggttttaaacgacgctttctattttttcacatttatctatgttttttttttttgatggagtttcattcttgtcgcccaggctggagtgcagtggtgcaatctcagcttactgcaacctccacctcccaggttcaagcaattctcctgcctcagcctctctagtagctgagattacaggcgcctgacaccatgcctggctaattttttttttttttttttttttgtatttttagtagagatcgggtttcagcatgttggccaggctggtcttgaactcctgacctcaggtgatccgcctgcctgggcctcccaaagtgctgggattacaggcatgagccaccgcgcccggccacatttatctatttttaattgattattagtcatttcctagtatattaagcaatccaaaaattttaaaacttaaatgtttaaatggaataaaaattgctggtgggaatgtataatacaaccactatggagattccttaaagaactaaaagtagaactaccatttgatccagcaatcccactgctgggtatctacccagaggaaaagaagtcattatacgaaaaagatgcttgcacacgcatgtttatagcagcacaattcgcaattgcaaaaatgtggaaccaacccaaatggccatcaatcaagtagtggataaataaagtgtggggtgtgtgtgtatatgtgtgtgtgtatatatatgtatatatgtgtgtgtgtatatatatctatttcatcatatatatgatggaatactactcagccataaaaaggagtgaattaatggcatttgcagcaacctcgatgatattgaagaccattattgtaagtgaagtaactcaggaatggaaaaccaaacattgtatgctctcactcataaatgggagctaagctatgaggatcaaaaagcataagaatgacacaatggactttggggactcagggggaaagggtgggaagggggtgagggataaaagactacaaattgggtgcagggtatactgcttgggtgatgggtgcactgaaacctcacaaaccaccacttgagaacttactcatgtaactaaataccacctgttccctgaataacccatggaaataaaaaatttttaaaaaatgaaaaaaaattaaatagaaattaaattaaactaaattaaacttaaataagtacaagtaaaattttaaatacaaattcaaaaatagatcaaataaataagaatttaaataacaattgagttaaaatttatattaaatatttaaatttaaattcaaaagcaaaaagcaacaaattgctaaaacaattccatcatatgatttgattatatatctgtacatatatgtataaataaaaaatatatatgtataatacatatgtaggtgagatatgttgaatgatttgacatgagaggtaaaatcatataaagtagtgaaaagggagtttggaaggccagaagggacatatgaagggttaaatgagtggtagctcatctttaaaatatattaactataagtatgaaattggacttgaaggattaaaaaaataaattggttaaaacttctaaaaatgctgaaagataactgtaaatgaaagtacattaaaatattttaaaaatttagtttaaactgaaaagtaattctgatatgattattgataatgaaatatgtagttctaaatgtatttaatgtgctttattaattattaaatagattgtataggaaatgcacatgtaacctattatcagatactaaggtggaatagttctgttaaagctgtttaaatagtccttggaacactctaaatgccatttaaaaaataaatcagaaaatttatgtattgcctttgatgaattaacagagccattatgtgtgtgtgcatgtgtgagtttgtgtgtt

SEQ ID NO: 9474 - DNA, 195 bp, artificial
  synthetic oligonucleotide
agaagaaaaaggagggaaagggttggcaaaaagatgggagaagagggatgcaagaaagcagaagtagaaagggaccagagagacagaaataaaattaagagagggatgaggagacaagaatactcttaaagaagaggaagatggaaaaagaggaagagaggtgccgaatgacagagaccaaggggggatagaaaa

SEQ ID NO: 9475 - DNA, 1817 bp, artificial
  synthetic oligonucleotide
ggaatttgaaacaagtcctagtaggataaagaaatctctgaacatattcataaggagtgtttctttagggaacttttctgtttcagggacaccactgaggctgtgccacattctgaaactgttgctatggcaaagcgtcttgtgttattgacgatggagcacattgttgtgtttaagtcatgtaaatgatcaggacacaaaggaagctgcccacagcagcccctgctcaatcaccacagcgctggggcctttcccccttgacacatgccatttacacggcatgggaaggcatttctttcagaaagcctcactccctgggtgctgtgaactgttctttggagacgtttatgagatctccacatctttcagaatcgattctgcaggggaaaaagaatacacaatgacaaagccctttcttttgttttaaggtcaggatatttctatagacattttgcattttctacctattaacacatttttttttccgggctgctggtcttgtctaatatttcaactttctatcagttcttgtcatttagagtccaactatgagagtttctcctttgtttcccacttatagctcaaatatgtgtttttaattattttccacagcatcaattcacactgattagacataattacagaaacaaaatatgcagaatacattttaataatgcctgtcacctctgagggaacaatgaggatctaatttaatgatctaagtgttgtttgaaagcgacacagagtttttaaaaatagtactatatattttgaagtggagcttattagtatttttagatacaaatgtaagctgaaatgaactattattcaggtttcaatgcatgtaattaaaaaaacacttagggcaatgcttgtttacacaaagaatcaaattataccctttaataataaaagcttgatccaactgtgacacttgagacttgaaatgatgtgataatttgtagtccaatttctaagggaaattttgccatatgaaaatctatttttgacaatactgtgtcaaagtcaatgtcctggttttgacattactgtggttatgaaagatgttttcattgggggaagccgcatgaatggtacgggggaactctctgcattagttttgcaaactcttgtgtgtctccaactatttcttttttttttttgagatggagtctcgctctgctgcccaggctggagtgcagtggtgcgatctcggctcactgcaaactctaccttctgggttcacaccattctcctgcctcagcctcccgagtagctgggactacaggcacccaccaccacacccagctgattttttgtatatttagcagagacggggtttccaccgtgttagccaggatggtctcaatctcctgacctcgtgatccacccacttcggcctcccaaagtgctgggattacaggcatgagccaccgcacccggcattgtgtctccaactatttcataataaaaaaagttatatcaaaaatctatttttcatacctaataaaaatatattttttctacttgtagaagaatatgctgtctcagtagagcttagaatattactattacagaaccatatgacattactctcaatatttgtcttggcatctggagtcaaaggaattttagacaatgagttaactttctcaaagaaaatctctttaccccgaattttcaacttgttcagaaaagaatttgtaaacagttatgaatgagaaatctacttacttttactgtttcagacgctcttctagaagttattaaaacagtatttacaattctcataaatctggaggcataattggatctca

SEQ ID NO: 9476 - DNA, 2125 bp, artificial
  synthetic oligonucleotide
tttccaacttcacgtaaatgccacaacaaactaggcatgggaaaaaccattccaagctgggggaagcaaaccttaggcataaggcacggagactgccatggttcctgaggaattgtgtgggaacagggattctggaaattgagctcagacaccaccgaggagaggacaggtggctctgcacaggatcaaataacttctttgttccagctaaggacctttgtcaaaaatgttttgcgttcctctttttccttttcaatcctttccaattacccttctccttccttttcctcatcccactttagtagacattaaaagtatgaggttggactgtgagtttgcagaacttaaagacgtcctccccacagtccctaccaaggcaagggcaattcattgcaagcagacggcacttgctcctccgcaagtgtttttctgcactcactgaaacttgccaagcctgcttgctgagcgaacaagcgagggggcaagaaggcggagggtttgcgctgaccattcgaagggggctctgcttcatctcccaaggctgtgggaaagggacagaaagttcgaaacccctcccctgcgctcttaaatggaaagctcacttcccccaaagtgtgcagggtggcgagcacccaacccacttagaagaaaaagtgaagagcttttccggttgcgatacagatgctaactttcccatccagatttattcagagctggtaaaagcaatagcattcctcttgaaatccctgcccttccaagcctattggcatgtttttccagccttgttttctccttatatgagtattgttcttgatatttaaatattgacataaaattcttccataactttgattgagttgtaaatcacaccctctccttggcttcctacatccactttttctttccttttcttgcttaacagcaaagctataaacctcttcctggactgataaggaattttatcatcatgccccagagccacagaagaagctgttggtttagaattcttttcaaagactcatttaagtaatcccccagccctttctccgctcactactttcagggctgccttctcacgtccagaagcaatacagtttccaaactgctagaacagaaaaacaaatttgcatttttctggaaggactgtctgtgctcatttcaagctggttccgccttctccgccagaaacacagtaagtgctcagaatgcgaaaccaaaatgagataagaggccccgtgaaattctttttcaggacattcagctgtctttattctagcccaaagcatagggtagaggcactaaaagctcgagatacatcctgcacgatacattccagcggccgcaaactggaattgatttacatatattctacaaactgcttgtaagccctttacaacgactgcctgacatcaaccacaattagaggcaaaagtgggggcgggtggcgaggaccagaccggggtggctcaggtaaaatgtgcttctttggttgtcttaggaaaatgcagccccgtctttccgccaaacgcatcgactacggccaggcgcctgctaacccagcaagctctccgcagtaacacgtcgcaggggtcccgggcggcgcccgccccctccgccgccagcgcaaccgcctgagcttacctgcctcatgtttagaatcccatgacccatccggcagggagcgagctgcatcggagcccgcgtcgcagtcttcagagcggaaacaccgaacccgacaggagcccgcaagacaaaagcaacccggcgaaatctacgggcagcaaagagcacgttttcgtcctctttttctttgatctgttgctacacgcactctgctcgagacaatgtcaagtttctcaaccttttctcccccagcctatgaaaagtcggtcgcagggaagcgaggaccgcctggctcttatttcaaatcagttctcagagacgttgtaggtggctggcttgggccgcggaggagcttcgccaatcagaagcaagggggtgggtcctgggagccagaaaggctgcctccgcgaggattaggggcgctttcgggattcaaatgactggaagcagctggaaacaatgtccaaagctccaaaagtaaaggatgagttctattcttatc

SEQ ID NO: 9477 - DNA, 1944 bp, artificial
  synthetic oligonucleotide
agaaggactgacatctggatcatattggcaagggggtgctttaaacataagagaaaattaggagaaagacctaagactggattacttccacgagttcactcaccgatacccgcccaagtactgtcttttttcttgtaactagcttgtcacccattctttctactcagtgaacaatggcttgtgacctcacagttagcgagttcataggagaaatatatcagttataattaatgtttactagaataaatgtaaatattttaaaacatacaacagttccaagaacatgtgatttccattttattttatgaaacattaaaaatccacttgtccaccccattaattataacctgctcccagccctgacctgtatataattcctcctgacataaattggaacaaggtgctcagaatagaagcagcctacaccccaactgggctacaaaatgtcaagttcccaaacctctcaaaagtgtaacctgacattttgctaagattagagacagtttatgaatttaaaaagagggcttaaggactcaccacagttaaacctacagtaactcctgaaatatccaaagtaaataggactaagggagccctggggacaccaaaaccctgttagaagagaaggaacagtctttagtgggtggtatttctttgcagaaaataatgtacatgcattcaaccagaattaagaagaatgcaacaataaactttgaggcttgaagccctctagagatctaaaggagtcatgaatgggccatgtgaaatatttctccttttgctacatgtgaatgattgaatttatactgcccattaatcctaaatgttgaaggcaaaaaaaaagagagagagagagaatggctaactttttaaatagtattcttcttgacatgaatataatatgtatttattatacatatgtataatgtatattggtgaatatttataacattcccaaagagcaaaacacctatagaaggatctaaccgcaaagaagcaacattccacaggttgatctttctagtcattttctgtacctcttagccacaaaaatgggatcagactttacgttttgttttgcaagttgttattttaaatataatatattgggtgatttttcatgtgtaaagattcttctgacttttcaagattaatttcaagtaccttttagtacaactaaagtattacagccaccttccaaatcaaatagactatataagctgaagatttactaaatattaaaatgttagcaatttttccccattataacatgcactgtcaataggggcaatattgcccccaagagcgagaaaactagttctcagtggcaaacaaacaaacaaacaaacaaaaaaccttactctttttatgcacaaagcacagatatacataaatagatttatactatatttgtggtattaaaatttcatgcaaggagcaattagcaaaaaatgtttcaacaggctccttgtgacagggggttgaaaatgaaaataggttgtaaacactgcactacagcatcagacttgtaaaaagtggccttcatattgctagagttcagaagatgattttttccattttaaatttatcaaccttgaatacatttttaactcatttcttagttgcagaaaccaaggttccaagcagcagatttttggagagttaatgttttgtgataaccccatggtcagcacatgtgatatctgccatgttcttactaaagactccttggggtctgggttaggaggcacatgttgagtgagaggatgttttgagggcagatgaacacatcatctcagaaagagctagggcctgctaagtctgcatctcaacatttatcagctcttgctctgtgctgccctcttgtgatgtctgggcctccagtatgccttgatctcaaaaccttcagttgccctaaattgatggaccacctgccttccagtg

SEQ ID NO: 9478 - DNA, 1198 bp, artificial
  synthetic oligonucleotide
aattttttaatgaatgcattttcatttctagtaggttctttatcacatctcccttttcttattgaatttctctctgttcctattacaaaaacacgattctcttctccataatctcaaaacaactaaacttacttattcttaagctcttttgagaaaaggcaattctgtatttccctgtgcttgttgactatttctcaaggatctgattttatctttgtcttgtaatttttgtctgacagctcatacgatgtaaactttgttccctgtgctgtgatttggggattgacatagcccagccagataagaagcatattctgaggttagggcgtgaggttcttttcccaaagaagacgctcccacaaggcactcgtgtgcaacagaggcacagatcctagtttgactcagtgcctctgcttccttccatgagagttctgtgtctggcttcaattccagagaagatgtcaggttccctttgagtccagtctatgcatgggggtcttggcctccaggtgtacaaggctcttgccacatgtgatgttcacttccctatgtgtccactgaagtcaccattgccccatgtcatctccacttcttgggagtagcccagtgtcagtcttctctcaccactctacactttctttcatttccggtccttggaggctttccacatatgtttatgcttggttatgtattcactaaaatacattttaaaatattttatctgtaattctcatgtgttcaaacttcagaggaaggctttgtgcacatttcatctggactggaaaaccaacaagaaaccttcaattctgtcttggaatcactcaaaacatttcaaatatgacaattttaaaggggaagaataactttttcacttaaagaatgggatacaagaggctgaagagtcagagaatgaactagacacagtgatttatgtacaacttgatcttatgcttgcatcaaagaaaaacttgcttttaacaacaacaacaacaacaacaaaagccaaagttttttttttttattgtttggattaaatgaatcgcaactgctaatcactttatggtcagagactagaggatgattttgaagcatcccattcttcaatgtccttgatatagacataaccattataacgtatatttgtcaacttttttggtatgttaatactaggggatacttttctttttggctgaccctt

SEQ ID NO: 9479 - DNA, 2795 bp, artificial
  synthetic oligonucleotide
ctaatctaagataccagcaactgtctcatctatattttgtgtgccagtaggaacaaacaaatgttgcccattaaactgtctcaccattcatttaagttgcagctcaatttcagcaatattagtcttcaaaaaaatgctaatcttagaatccataaatgcaatattctactagctgagcacctgattggctactctactgttctttaaatatgttgttatatgtgtgtacactgttctctaacatattgtaatctttattattatttgctacattgtgcatctactgacagttataggcacataggaggctataaacttataattactgcgtagacgatcaaagggacttgaaggaattcttattgcaaaaatggagttactgtcaaaatttttaaatgcctgctcaaaataatttgcttctccaactttagatattttaggggagctgaacttgcaggcattcaaatagtgttcaaaatttgccatttggagagtcatcatgcaaattcatctaaaacaaattccctgagctcctactgtgtgaaaatcattgcatcagagtctgtgagatacaaagacgaattagatttgattcccatcctctaagacctcacattctggttggaaaaatggaactggtacatgaaagaatgataaagccatgagaagattattactattcttgcattgctataaagaaatacctgatactgggtaatttacaaagaaaaggggtttaattggttcacgggtgctgcagggctacacaggaagcatggcaccaggcatgtgctcggcttctgatgaggcctcaggaagcttttacacatggtagaaggcaaagccagaactggcacgtcacatggcgaaattaggagcaagagaaagagtgtgtatgggaggggggcgggcggtgggggaggagtgtcatacacttttaaacaaccagatcttgtgagaactcactcattatcatggaatcagcaccaagccatgagggatctgcccccatgacccaaacacctcccaccaagccccacctccagcattggggattacaattcgacatgagattggggcggggacatctctcctttctctgaatcacatacacggtatcataaaatgttacgtgattcagagaaaggagcgatgactctggtccagggaaccagagaaacgttcacaactgaagtgccccttgacttaggacttggaggatacacaagaagcattctgacaaatagacatgggttagaggaatgggcctaccagtcagagggaactgcttggttaagggccagaaggcttaaaagtgtaatgaatgataattgtttagtttcagttcatggggtggggtggtaaaaaagacagtttgggagaagatggaagaggaatttgaaaatcacataaaggaagtggcatctattttttccttattcagtgtagtcattgcaggttctgctgttgttgcaattgtggtttatttcatggaaacatatctgacaactaagatgcattaatatacacctgcagtgcattaaactgtgtccgcaaaaaggtatgttcaagtcctaacccttggtacctgtaaatgggaccttatttgaaaacagaatctttgttttttcttttttgagacaaggtctcactctgtcgcctaggctggagtgcagtggtgcaatctcagctcactgcagcctcgatttcccaggcttgggtgatcctcccacctcagcctcccaagtaactgggaccacaggtgtgtgctcccacgcctggctaattttttgtattttttaatagagatgggtttttgccatgttgcccaggctggtctcctgagctcaagcgatcctcctgccttagcctcccaaagtgctgggattacagggtgtgagccaccatgcctggcctgaaaatagagtcttcgcagatgtaatcaagttaaagtgaggtaaggctggagtagggtgggctctttataacaataaggaaatttggacacatattcagagacacaccaggagaatgtgataacggaggaagggtttagagcgctgtagctgaaagccaaggaactccaagaattgcctgcaactaccagaaaatgggaagaggcaaggaaggatcctcccctagaacctttgtagggagcatggccctgccaaaatcttgatttcagacttctagtctccaaaactgagagaataaattagtcttgtttcatactttcccagtttgtggtaatttgttatggtagccatagtacactaatacaataccttttttttgagacggagtctccctctgttgcccagactggagtgcagtggtgcgatctcagctcactgcaagctccgcctcccgggttcatgccattctcctgcctccgcctctggagtagctgggactacaggtgcatgccaccacgcccagctaattttttgtatttttagtagagacggggtttcactgtgttagccaggatggtctcgatctcctgacctcgtgatctgcctgcctcggcctcccaaagtgctggggttacaggcgtgagccaccacgcccggcctacaataccttttttgactgttctttgtaagggcaattaaaatctccaacattaggactgctatgtaatgctagatcaggaagagctataatgggaatgggaagcagccctggatgggaaagactctctgaagttctaattccttttaatttcctccatcttttattttggcttttgcaaaatatttaattttaagaaagattcttgttttaaaattata

SEQ ID NO: 9480 - DNA, 2370 bp, artificial
  synthetic oligonucleotide
cctcactctcatccttttcaatttacaaaactcatcatctgagcagaaatctaattaaacagccttaattcctccacaagaaccttgtcactttacatgacaactagcactggagaaactcagagaaagccgtatgagagcaaactttccattaaaataaaacaacaacaaagatagattaaaaacttagtgagaaaaataatggcaaaaagaattttaagaagtgattacaaacaaggcaagataaaccaaaggggccaatgctggaactttgaagtgatgttggattagaaaatgcccttctaggatgaccttgagcaagaatggtaaggactgctgagcctttatcctcttgaaaccattatggcaattggccaccctttcccagttgttcttggccatcatctttagagtcactggcacctatcatttccaaaacgaacatctattaagtgtcaaggtgttgtatttgctgtaaaagaacttgattattggaatgtgcagaaaatttggtacatatcagtgattccaagtgtttgcttagctaataaactgtgtcttctgatttttcaaagaaaatggaaagagaaatgtgatgaagagatacagtccttatctgacctagaaaagttaagttctacaggtgacccaaattttgatcatttctcataagcttgtctttcactacatatataattaactccaaacttgtctagtgtaactacaaactcatccattctaccttatttctctcctgaagaaaacaaaatagagtggttgaaaacccattagtttttacaatcctagacaaacatttcttaggagtctacctgaagttgctcttttttttttttttttttttttttgagacggagtctcgctctgtcccccaggctggagtgcagcagtgtgatctcagctcactgcaagctctgcctcccgggttcacgccattctcctgcctcagcctcccgagtagctgggactacaggcgcccgccaccatgcccggctaattttttgtatttttagtagagacagggtttcaccgtgttagccaggatggtctcgatctcctgacctcgtgatccacccacctgggcctcccaaagtgctgggattacaggcgtgagccaccgcacctggcctgaagttgctctttcaatgtctctgcctcctgagtcccaaactgtcttggccttcatactctgctcttgtgtgtgtgtgtgtgtgtgtgtgtgtgtgtgtgtgtgtgtgtgtgtgtgcgcgcgcgcacgcgtgtgttttaagagacagggtctcactctgtcacccaggctggagagcagttgcactccatgggtcactgtagcctcgacctcccaggctcaagcaatcctccagtcttggcctcctttgttactgggattacaggcgcacaccaccacgcctgtctagtttttttattttttgtagagacgaggtctcactgtattgcccaggctgttattgaatccttgggctcaagtaatcctcctgccttggccgcccaaagtatgctgggattacaggcatgagccacagcatgccattctctgttatccaccgttttaaaaatgtttggcacttacaatcaaaaagccattcatttgcttaccctcatttaaaaaacaagttatgaaaacaatgtggcaggggtggggagagttgggtggctgaaggggaaccttcaaactgttttccattctgaagaaaagcagaggtaaatccctgggaagagatgtggacttataaggatgtggcatttcctcatgggtcgtgggaaggaattcattgatttaatttacaacaattaggaggtgcctctgtgctgtgagttttttttagctccagctggcatgggaattattttcccggggaatgctcatacccaaatacaaggacaccttcaggaagaggaaaaggaagaagtaccatctaggaaccaaggatgtggaccaggaaattcttttccactgcactgatttaaaagaatagcatgctggtgcctaacaaactccatggcctttttggagtttcctagtgctgtgaaggtttcccttggacatgagattgttttgcatgacaatatccatattattttctcaataaccaaaaatgtcatttcctgaaaagagttggaaatgccagttgtcactgtgaaactcacacaggtctatgtgttccttgaaccctcactaaaccttcaaaaccaaagttcaaattcagatgcaacacgaaagcctttccagctctcaactctcccaaactagttcctacagatccttccttcttccatgctttccatttctccagaatgaactacttgctttgtgtacatacattcctcgtc

SEQ ID NO: 9481 - DNA, 1568 bp, artificial
  synthetic oligonucleotide
tttccaaatttccactgcagctgagttttctttctaatttcaatatctatatttttccctccaaaactgctaatttgttgctttcctatctatttttttatttcatttccttcttttgtggcttcactttttttgctcttttgaaagagaagttattccttcatttctttctttgaacatcttaagactacttcttttaaagtctttttcttattttcctataaaattaattttatctggggtaagataatgttgtctgctgattttgctggctgtatgtttagaaatttaagatttctttatatactttgaaattaaacttagagtttcagttttaaagggaagtaatttataattctttcctctctcaccctccttgctcagcctaccctgctctgatagttttccagttgccttcacctggcccttgaggtcattattcaggaatcccatccttatctctgtgctcctgttctgtgtgggtatcagaaacagtgtgaacacaggcttcaagctaacaatgtgactttgctaaaagctatgatatgagggaaaggttggcaataatttttgactgaagcatgaagccttctatagcccatggcattaaataatgagcctgatttccattccccatcccatctggagcacttctaggtcctttccccaaagcttcaagaactatttatccacaggagctaaagccaaagctactttggcctcttccagaccaaatcccagtagcctgtatcctcagccacagtcatggcttttcagttttgtctcatttctggcctgtggagatgtttatcttgtttttggttcagctatatgtctttgcttttgcattttattaagttctttattactgacatgtatttggggtagaacgagtgcaccgaagcataaactccatgcatcactatggctggaacttggggacacctgcactactctgatctagctcatgagagaaaccctggtggtgggaagtccaagctaagtaagagaagggaaggcaagctagccaggaagttgtggtggagtgcccttgcaggctgaataagggctctcaatgctgcccacatcctaatctcaggaatctttgaatatgttactcacatggcaaaagggactttacagacatgattaaggatcacgagatggggatgttaccctgaattatccaggtaatcccaatgtagtcacaagggtcgttataagagaaaggcaggaaggcctgtgtcagagaagacgtgaggatgggaagagaggtcagattgatgcaaagagaccatgagccaaagaatgcaggctacctgtaagagctagaaaaggcaagaaaaaatggattttcccctaaagcttccagaaagaaacagcactgccaaaaccttgactgtcgattttgtttaacccagtgagatcgatttttggatttccgaatttcagcacactgagataataaatctatgttgtctcaagccaccaagtttaaggtaatttgttattgcagcaataagaaactagtaagagtaaggtgcaaaacctcaattagagaggaagag

SEQ ID NO: 9482 - DNA, 5791 bp, artificial
  synthetic oligonucleotide
gattaatactatatatatatatttgtttctctctctatgtatctctctatatatttgtttctctctatatatttgtttctggcttctttcccttaacatccatgtggtttgctagaggtcattaattttcatcaatatttagccagctgtttttactaatgtagtacaagtgagtgctatcacttttttgttcaagaaagacaagtcaataaatattgtgtgttctttccttccttgtcttcctttgaagtttaaattcaggaatgcaatcaatctgaagaaagccaccaaagacagaaataaataggccatgagatactcactaacgacgttggcttgtccggtgaatatggtgtactggagctcgtaggagaccacgctgaactcatcatcggaggtccaatgcacagtgatggtgtcatatgaagctgtgcagagctcttctctaattgtgggagggttgggagctgtgggggtcaagaatgcttatcagtggaaaagcacacacaactgggataccatttcagaggagatgtttgacagttaagcaggtccttctcaataggtccatcaggactactatcctagagatggtgaccccaatctaaagaatatctgattggctggttattgcttttgtttttaataaggagtgtgactagagtcagccagtatggactttctgtgtttatcatgagatcatgagaatatgtttgggaggttaaacaaataatactttcttgtgcatgaaggaaaacttgtcaaataaaaagtaaacaagataaagtttcatagctgcattcactttgggaggttggctaactttttcagtaaaggccttgatggtaaatgtttccagctttgtgggccatacagtctctgttgcaactagtcaactctgccattgtagcatgaaaacagtcacaacttatacatgtgggcatggccaggttccaataaaactttatttacaaatataggtagagggtcagatttgggctgtaacccaaagttcaccaacccctgacctattaatacgtggtgccagatacttatatctttaggcacccaattgaaaaaatacttatgtttgttatcctacaaaaaatcagccacataattgtttgaatttttctttcattagatgtttcgatgacttacataaaaaaaagaacttactagtccagccctattttcttctcatttctcaactcatgcgatatttcaaattcagaagaccatgattcatagtcaatcatatctaaaaggtacattttccttccccaaggaaaaaacttttttttggcatttggttaatttatcattgtagaaggctgctgttttatttctttaacacattctggagcagagaagtctaagtcctaccaaaataatgagtttaaaatgacttctactgaattgatttcagtaactggttttatgagaagagtatgtgagcaaggaaaatatgagaaaatgagtgctttgcattgtaaataatattttagagggaggggttggcaaactgtgactgtgggccaagtctggcccactgcctgtttttgtaaataaagttttattggaacacagccagattcattcatttatgtattgtctatggctgctttggagcaacagcaaagttgagtagttgtggccatatggactgcaaagcctaaagtgtctactatctggtggtttgcagtcaaagtttgctgacctctggtttagagaattgatccagggcctttacttccactcttctacccactagaatctcacttcaaaaggagaaacatacctgcactctacaaactaggagcaacctttgcttgtactatttcagagttatttcctgctctaaattatgattagaattgatgagtcctaagcaaacccaaagaggaagaaaagtttataaaaactgtaaatttaaactctgcgttagtagtcttcactttgctttttgaatatacctctaggacaagtatcacagaagcaagtctacggtattaagtcaattagcttagctttatctattggttctgaattccagaaacattgttgagcacctccaacgtgacaggcatggcattaaattgtgcattaagacagaagggttctacataacctttaaagcattctttctggaatatgtatttgtacatctgtctcctgaagtattcacatgtgagatttagtgtcatgtggtatgacttggatgtgcatgaatcagtgacaccaatcaggatatgcattccacggaggaggtccagctgcatcgtaaaatgtgcttattattgtctgtgtggtccctgttggtgtgggatcactcctgcatggaccagtgaagaaatacttactctctcacaatttaaacagttcattgaattatttctccatcaaccattgtagaaaaattttgttctgtattgcaatatacaattaaatagaaagaaaacgtatgttcaaaataggcaagtagctgtgagacacatggtagtagccataatcaggaaggaaatgtcacctctatgggttattaacttgatataccacttagaggcatgtcataggaaaaaaaaaatcttgtttttacaatgagacaggctaaccttattttgactgtaaacccaatgagtttgtcctgagaagtcaatactcaatttagtgtaaatgagaacagcagcatgctgccaatttcaatactcatggaatcagtaccagaagtgttattttcttgtctctgtcacaaacaccacccaaggaatggtgggctaatactccacaaagacttcatttcctgcttacaaatgtcataaactatttggacttggcagtatcagccaagcatcatatgttatggtcaggatcgatgttatgtctagaaatggactgaatttgtatttggggttgacagctcagaagacataatagcaggtaccccatatggcctttagtttgaaataaacagccatcgggatgaaatatggtgtatgttacaattcagtctaaactactttcacaatttcccctttaatcaatacttttgcattcctatagagattaaaatgggtatatgttgttgaaatactatgaaataattattgggaaatggcaagggcacattcttgtcaataagactgattctgggcagaatggccatgtgcctaggcaaatacttaattttccagtcttttctgtccctggacatgaccttgtaacacagatacagcccaccagacataagtggaagtttgctaggcgggtcttctgatcaagctttttgtttttctgataaacaaacttcactggcagagcattttgtccatcgtttcccctccacccctttctttttgcctagagcttgagcacaacacttggaggtggagtagtcatgttgtgatcatgtggcaaaaaggcaacacaatgaaggcggcagaggaggaaaaaagaaagagcctggggtctgaggtcgtcactgaaccactgcccagccctggaacacaggcttctcttctgtgactgtaatacaaacactccttgatggttttattcactgctagttggattttttgttgcttgcaactaaactcattcgcaaatgatataagaaaaaggagatttttaacaggatgccactgtgaaaaacagcttagctggagaaagtctagacctgcactgttcaatacaatagccacgagctacatgtggtggtttaaatttcaattaaatttagttgaagttaaataaaagtaaaaattcactagccacatttcaagttttcaatagccccatgtgggaggcagctaacgctggatagtacagatatagaacatatctatcatcatagaaagttttattggatagtgtcagtttaaataaatctcagagttaaaagcttaaataggagggcattatgtacacaaatatttgaaaccaagtttagttccatacggtaaatgcttttttagtcaatttctttcttccttaataggagtggtatgtttgaaagagagagttacataagataagaagtttgtggaatgcctgcctgccttgcttgacaatgcagaaaggctaaaaacggcacattgggtcctcgcaaagaaaaaatgctcatcttctgggtacaatgctccctgaatatagaacccctggccttctatccacagactgtaaaaacaaacatcacacaatgttccctttctcctgctccaccttgttcaatcgctttctcacaaacatgtacacacagaattggaattgagaagctcatgtcacgctaagttagagacgtggtctcttgaaggctgtatgtcttaagtgcagcgcacatctggcttcactgtgtacattgtgctttcctgaagtcgcaggcactggtggctttggctaacacgaataaggttgtctaaacagtccaggttctaccagtgaatattctcagttcctactttagaagttgacagcaaagaaaagtttagaagcatgcttaggaataggagtggcctgaggtttttgttgttttgttgttgtttttgttttttaagctcaaccaagggagaaacaaaacaaaacaaaacaccaaccaggaagcacactgaaacacagcactaggaattccaatgtaaatttgtgacctttgccatggtgacatttgccaagataaaattcagtcttttactagaaagagcagaagtttttggagtttgtacaggtcccagccaaattctaattctgtcattccctagttacctgatttccagcaagacggctgatctctgtcatttgcaaaatggggattataatgctttacctcaactcgatgttgtgcaaattaaaacaagatcacaaatacaaggagatgaagcagtacagacaaccaatcagttagctgccaattttttctctgccaatgtattgtgagttgcttactactatgatatgaaaaataccacagagagatactatttttagcacccacaccttgagagtgagggaaacagtggtaagtatgcttttaatggttgagattctcctttttctcctgtccccagtttagtaatgggctgtgttgttttgatgaaaaaacaaagggcaatgcacagaaattgtttatggaaatatcagtgccattcctaggtcaaaagcccattcctctggttattggggaataactgatctggtggcaaagtgtttatatcactaagtgtgcacaatattaaagagaacataaaagacaatacctgtaaggtaatccagacattctagcagtttcttctctcgggaaaaatctaaggcaaaggtgtcaaatgtgtcattgaggttgatttcaggaattagaacctgggaggatgcagttgccatggagactctgtaatgcaaacaaaacaatgtttcagaaatgtcaagatgactttcaacatcactgcatagaaatgaaaaagaaaaggaaaataaatatctcttaaaaagtgcttttttacacatgagttttaagaggcatctcaaaatgtcacaacacagtaacataaaacaaatgaatgcaagctttaaaaaaaagtgaaggaattggagaaaacaacaaaatggcttgccctcttcctttttactatcaggaaaaaaaattccctgcgaaagcaaaagaatattcatatttcatgttgctgtgtatttaacagtctggcccggtcacgtctaaccccagcaagaagcgcgtagctctaggcatttcttcacacatctgtctgggaaactgtttgttcctttcagacgcaaccctgatcca

SEQ ID NO: 9483 - DNA, 423 bp, artificial
  synthetic oligonucleotide
ggaggcttttgtttccttggcagaccctctgaatcacgcttgcaaactgttgccaggccctgttttcagttggcacgtttttcagttgctttcaaaatcgcttcttggttaccctgtaaaatgtttcggagaagcctatgccgcttggggttttaggtgctgtaactgttcaccctgcttttgggcggggggggggggggtggggggcgaggggtgggcggggagtgtgtgtgtctgcctgtgcgccctgtgatgtttttggttcttttatatttcacacatattcgtgggtgcgtgcacatttttgataccagccttgtggtttgtttggtagtggaggcctttaaagtctgaccagcttggttgtgtggcatcttttagtatttttttcccttgagttgttttctccttcacagcgttcgc

SEQ ID NO: 9484 - DNA, 1896 bp, artificial
  synthetic oligonucleotide
agagcagccctatgtggatttgttgcaccccctaagcccaggctcaggcaccaggatttaatttatcttggggaattagagtcagggttttcctttcattaacactcccaattccctactccagtttcccttggcctctggcctcaattccagtaatttctggctcctgagagggcttatgcaaactcccttaggacatgaagtatgtatgctagggcctttcctctctggggaaatcatgcctggaggccccttcccctttcttccctctgtatctcacaggagagtctgggttgacttttatcaactgtataggggaaagtttgggagctttgaggagcatatggatctggcttacagtctcagctctaccattcactagttgtttggccttgggcatgtcacagaaccttggtttcctcatctataaaacatgcctggcatgtaaaaggcactcaataaatgctatctgtttttaatattacccgtatgcaaaataataatgagcgaggtaccattagcaataagaaaactgatttcttcaatccaaatgaagataaaagagaaaggactagttaagagaaggctcaaatgccaaacccagtacactctggaacagcactctcaaattgtagtgggcatactaattacctggggatcttgttaaaatgcagattttgattcagcgaggcccaggttctgacttttaataagctccagagtgatactgatgctcctggtgtgataaccacattctgagtggcaatataccaggacataatctggtccaaaaaatgcatcaggttaaaatctcttttcatttcattcctcaggcctgggtgtccggccgcccttgctcttctggtcgccaaatgtctttctccttttgctcagtggcccagcccatgcaaacgcttgcctgaagaagtttgccaatccccacttcctaacaaaataaagagcaactggtttgttatcagtgtgaccctgccagtggccaggtgaggctgaagaaattgtgactagaggtgcaagcatgttcatggagctggctgaggtagggagaaagggtgcgaagatgagagttgggatgtcatcagatgaggagtaggcaggtgggcacaaatagtgtatactcaagaaatccttcgttgagggaagatgagagagaaacttgagcggtttagccagtttgggatttggggaagaggttgggagaggtggtggagggaaaagggcatatgctcccatttagcggagctgagttccagataacatgatcaagtatgacctcctgtgctcaggggacggtaaagatgactgcttcttttccaagtactcaggagacgtgaacttggcatgggggcacaggagggtgggcacatgcagcagaaaagccagaagctggctcccaggagaggccttataaaggctcttgtgagaggtgaggggtggaggtggaccaattctgaaaggagtcagtctccagctgcgctagtcagctgtcaccccagtatcttccgatagcaccatctgtctttgagcctggctcccagcagacccctgaagagatacttgggagaagatgagcagaaagagaaccatgactctgctctaacttaggggaaaaaggaaaatgtaacccctgttgcttgtggttgtgctcaacctgaggcctggaccataacagagtgtgggtactttcctctttttaaagtatttatataaatagaagcacaaaataacgtccttgattagctctgtttattttctgtggctcttccagcctccctccaaacagcacattccacctgccccacacgaagaagcccaagctcattctggcaggctcagcaggaagggaagcccacagacaagccggaggacagaacaatg

SEQ ID NO: 9485 - DNA, 1341 bp, artificial
  synthetic oligonucleotide
taccattaccccaatttcacagatgagaaacagcccacaccataggtaaatggtagaagaagcattatgaatttagacagtctggctccagagcctatagtcttaactaatatcccatttacctcctggagtgtgcaaggtgttttcatgagggtgtgtggtgatagaggtccaattagatcacacagactgtgaagtcatgagtcgagagagtttgataggtaagaagggaggcagcttcaaagaatattgaattctagaggcttgcatcaagtgttgtagaacaagcacagcaggcccaactttgaatcctgaatctgccattgattagttatgggacatgggcaaagtcagtagtagccttcatttcctcatatttcaactgggtatgtcaatgccaattttgaaaggttgttgtaattattaaattaaaagcatgtaaagtgtccagcacagggtagatcaccataaatggaagctatgactattattactttatgacttgtagagttctcagcatagacttcagaagaactattttagtgttactagtcagtgatcccttaaaggcccatctaaatggaattcctagtgaaaatacatttactttttgggtcaattcctctcctggtggcttgtggctcagactactgaccctctatagctttgggttgctggtatcttccagttggcaagtatgaccatggacaggcttgagttaggaaagctgtcccacatatgtggccaccattcttagggggtagtgtgccaccattggggtgggaatagctaaaaaggagtgagattatatcttaactacttttcctgctattggtctatatgccattgctagaattgggagatgtctgcattgcccagtccctgttatctacaccagtccagagaatttggggaagctatgtgtacatggatgggatgtgttatattagattcagaatagactaaagggtgacagacttttccccatttcctagtacactctgctctctgatgaagtgttatgcctctcccttttcattttttggatctgctaagaaacttttaacctgcctgatatcttcctggaaatgtagttgttagaaggatgcaattgaaagcatgactagaattagctgctattctcaagaattttcaaactgtaaatcctagtagacaggacccaaaaaacagggagttgggaggagcaaaaccaattaattttcacatgtctgcaaatgttttaacgtacagctatcacccaaaatagaaaaccagagctttctctcttctaggttaaaaatgtctgcctagagatctgagacacttcttaaaggtgacctg

SEQ ID NO: 9486 - DNA, 4509 bp, artificial
  synthetic oligonucleotide
gttttttccccccaagcttgcctcgaggaggcagtgtttgaaaacaacatcaccccagctaagatgacaacctgtttgccttgaatgttaagatacaagccagctggttgcaggtgccatttgtctgaggaagatgcaggagagaatgatcctatcactgaagatcagatgttcccagctgcaccagagagcaattgcatagcaacattgagggtgttgtaaaagggtttggctccaagcaatttaatttgagcacgtacctagatcctttacatccttcaaaattctccagagccactgattagttaatctgcatggccttcttaacggatggtcgtggttcttaaccccattctacagataagtgattcaacaaatgtctggctctactaagggcaaagtcaaacccctgggatcctggtctcctgccagtgttgccagatgtctgtgggtcagctagccagcacgtctgagtgggcactacgtagaggaaactaatctgattccccttaccttaatcttcctcatctgtctggcaatgacattttcctgtcaaacaggtaggagatgctttcgcatgggagcaggggatgcttttcactgggggaagggtcctggtcgccagtcagcctttcagaggccaaaggggagatgcattctctgggtattacgtccccacgtgtcagtttcacagccatgttcccaaaatttcgcttaagatggccacaggtcaggtgattcctgcttgtctctttcccaccagcttaatgcaaactcttccaaaaagacaagatcaatcacccggtgagggtgagctcccaaatctagccaccccaactttgcccttcttaagatcactgcaggaaagggtattttcaggaaggggagggatacatcccctggtgagagctagggtgttgaatttttaaaaacttatcagagtctcccaccgtcatgttttatttatttttaaacctctgcactttcttttctctgtgaaacttttcattttagccttctttttcagttattcgtcattgcagatattttgcaaactcaagcctccctactaagaactcaggaagcaaccaatgcttccatttcgtgatgccaatctgccccctcccctcccgcattctacattctataagtgtgcggtccacagcagaagggttcctgagccgtgtccttatggtctgctaggcagcaggatggaccggtattgttcgtgtgttgtgttattcgtttgtgtgtgtgtgtgtgtgtgtgtgaatgcgcgcgcgtgtgtatgtcttcctgcaggggaagctaaattgaggtgtgtgtgtgcattatcctggttttcagttttgtggaacgaagtttagggtaaaggaagagtagggagagtgcagagaaagcaggaaagacaggcatactcccgcttaagagcagacggggtttcagggtccaaggtaaacacgaaaacctttttcctccctactccccttgggcgagtgccagaagattctccactcatcttttcccggctaagtgtaacgatttagaaggcgtcgcggtagactggtagagatgaaggttccccttcacacgttctgcaatcccaactcctattttcgtgtctctaaaccaggactcctgtaccattccaattggccctggtgcgggatgccagttgccccgtttgtgacgctgcgcaacattgtatcactgcgtttgcacctacctgctgggaaatcctgcagacagatggaatggtggcttcgacacacgcatgctctccccctcctcccggagaaccctgcccttcccctgcagtgcgcgtgggcgccgcccatcccctcgtcctcaccaggagtaccagctcgaagcagccggcagaggcgccgggcacctccctggagggccgccagttgcgcccagctgaggcgccccctccccagtggcagggagggggccaagcaggcgaaggctccgcagcttgggcctctgcggcagtgaccgcggctaagaggtgtgtcccaccgcccccactcaatccgtccgctatgtattcggggccagccccaaacacttctccaggtctcttgcgctccccgagggtatcttcctcctctctttcaagatattggcgctcaccgcactgtcgcttctcttcaaggggaaaactgctccgattcccaccccctgctgtcacccccgtttctagccccaaacagcccattctcgattcccacatgttgcttcccgcctcccaaccccttcccattcccccgggttccccatccctgcatctttctcagcatcttggccagccagtgccagacaagcgggatgcaaggggtacccggagtcccgcgggctccatagccatctgacttcgccttgcttcttttccccgcttcagggggtcttttgcttacctttattctggaccacgacattggcgttctgggcgatggcgatggcgatggcgatggcgaggtctttagacctctctctcgagtgtccaccggacattgcaatagacatggtgctggacttggacggaactctggagccgcctcagggcagaactctggggccagctctgtcacaggttctggggtcggctctggggccagctctggggcaacttctggagtcagctctggggccggctctgggaccgactctagggcaggttctggagtcggctctggggcagactctgtggcaggttctggggccggttctggggccggctctgtggcaggttctggggccggctctgtggcaggttctggggccggttctgaggccggctctgtggctggttctggggtcggttctgtgtacagttctgtggctgattctgaggtcgcctctggacagggacctggagcaagctctggacagggctctggtatgggttctggcgaagcctcggagagcagcggcggagccggcggcggagccggtggtggtggcggcggcggccaaggcggcggaggctctggagactcagcgggctgctctccatcctgaggcggggcagtgccctgggctgcggcagctccgcggtccatggccgcacaccgcttcaggtctgggcagcctgagtccctaagcctggaaggctaaagtaccctcgggcgccccgcccactccagtccggcagcccctcgcagggtgccaaactttcccccatcccactccatggctggcttggctctgaggtctaacccgtgggcgctcagcgtctccctatgctggaacacgcccctcagtgtgcgcacacctcttcgtaagcagccacgggtccgatgggcgggaagcagaggggcttgcgaacgcggactgggcagagcgcttgatgacctcctagcgacgcgcgggaggggaggggagagacaaaaaggggagggggagtggagcggcgtggaggttggggggcgggctggagccttgccgtgtttaaccctttagtgacacgaatgaaaaaaaaaagccagaggcgaagttgagggtctttgcaatcccccaaccacttagctgctggtcagaatagcttccatcctgtgtctgctctctcacctcagcagcaggtgagcttagcctcggaccaacctcttgccccccatctccaagcctcgatgggcaagtaatgctttttatctaagccgggaaaagaaattaagcggcatggtgtgtgtgtggtgggggggggggggtgcggggggggcgggtgttcagcctcctttggattgaagtacaatttgaccctcttcggttttttgcatttctgagctttgccgttgggtacagagtttgaggtgattcgggaaaggagtgtgatgagggaggctggcgccccggctttccgcagcctgcagcctccccgagagcaagtcgagagtgccccggcagcagctgggcttcgcgctcgggagctgaggctatctgggcgtctgtctggctcgcctatgctataggagcctgccttgtgcttttagctggatttcccagccatcagcaggagtttgtttttccgccccccccaaacttgttaacgcgcgcgcgcgcgcgcgtgtgtgtgtgtgtctgtgtgtgtgtgtgtgtgtgtcttgggctggggaaattcactgcaacacccacacccttttcacctcctgaagcagtctgacattagagatgggagattctcttgggaagagaacgactgatgcctagcgcagcacctttcccaccacatcggaagactttagaagctctttctgttatagtcacgtacacatacacacaaaccatcatcttagtcagacctagactttagacgccaatatattaccaattgtaattaaaatttgagaagactacctgttaagccacagctgggtggggggagcggacgggggagaaatacctgtaaacctgatttgaaatatgacaagtgaatttatctcccatacacataatgctgcagttgtgggtagcagccttctttctgcagccccttctctagccatc

SEQ ID NO: 9487 - DNA, 1358 bp, artificial
  synthetic oligonucleotide
aaaagggtcccctgttataagccaagttgaattccacccccacccactcaaaaagtagacaagcatcatgacatgcaccactacctgttattagttggctgctcttccgttttaatttctcttgttgctcttgtgtaggaggctggatcaagttgggggatgagtaagctatcattcccaggtgagaactgaattattacgggcacaactgagaaggccagctttctgtctatgactccttcagtccaaagacctggaacatctattgtctttgcttgggttagagtgctgggaagaaagctgtttcctaacactcgcttgccaaagttgattcaaagcaactgtgtttgatttggttaaaatgcaactccgggtgctttaggctttaagaaaggtcagacccactgctccactgaaagctttacattccccagggtcctgttgacatggcaggagtcagacagactggctccagcacttactagctgtgtgaccttgggcaaatcacttaacctctctgagcctcaatttccttgtctgttagatgagaataccttacagagcatgtgcctgccactctgtgagtcccttgtcacttgtggattgtggagccaagggctgctgccatcgctctgctcatgccactactggaatcttccctcctggctgtctaagggctgcagcagcaggatgaggaataggatgaccaactgtcctggttttcccaggagtttcagcactacaatcaggagggtcttgggcaaactgagacctcgtggtcatcctaacactgaaaagccagatctttctaccacgcaggtctgcaaggactgtatctgcaaatctcctcccactgcttcctgtgctaaggaagagctatagatgaacgtctgtgtccctgttctctatcagtgaaataaaagaaagttgataatgatgctatacgtatttatttttatgaataggcaaaaactttaaccagttccttgcatatcactaaaaaggtattttacacacgtgagcaaacatatatacacatatattcttttttcttcctgtaaatcgtagcattctatgtacaatgttttgtttcttgctttctacacttaatatacaatgaacccttttagatgttgatacatattaagtggtttcctttctttttacaattgcatagcattctactaaatgaatgtaatgtgatttatttaaacaattccctattgaaagacagtgctttcaaatcttattttattacaaatgacactgcaaaaactctgtatatacatgtcattttgcactggtctgagtacattgataaaataaatatcaagagttgatgactttaaaactagtcc

SEQ ID NO: 9488 - DNA, 2010 bp, artificial
  synthetic oligonucleotide
acactgagagtctagcagatgtagaccatgggcaggacttgatcttttcccagagggcaggagggatcatggatagctacagcatcagtcattgcttccattgccctacttgcctttactataagctccccaagtcttgaagctagagctcaccacaccaacaaggaatttgtttcttcttttgcatgtaacacagtgagattatgtggtcgatggaaataggagctagttgggattgtgataacagccactcctttggtccaaacccattcttgagtggggctgatgttcagtgcttctgtgctttaattaagttaaggggcagcctagcctttatgatttctttctttgtagaatggaaaccaaaaacattaccctataggctcatcacccaaagactcagctttttgggactggtcaacagagccctcagttttaccctgtgtcagggtgatgtaatgagagagtaacaaagcaaaatcttcttcttagacccagccgctctcctttcaagggaggatggaacatgaaccaactatggaagcaggatattgggtctgcagctctttagtctgttaggtactatcccctacatgcctaagcaggaactccagtctccatatcccaccactgaggctgggagaagacaattctggaaggaggtgggtaggagaattcctgggccaccaagctttctatttttcagtgagttttctggtctggattcacttgaatgaccaaagccatgtgacatttcagtcacacaaagccctagacacttccctagaaaatcttctgctttctttgaggcactttcatcagtaatctcaacatggggtagatttcactttgaattagggctcttatctacctcatcagaggagaggatgtcatgtaactcaattatcctgccattttctataacatattagcagtctcttgaaagactcccagtgatactcttctaaatcaccttcactgggaggactgatttttataagtcacatactcccttccccttgaaatcagcttagctttatactggtaataaggaacaagaccatcactttttttcttccctatcagtgggctgctagaaaatgtttgcatgaatgataacactttgggatcaaaggaaactttggaaacctgaagttcaaagaagcaagaagtggtcatggaaagctatcttcccagctagcccctacccctgcccattcagtcattcccaatcttacttacacaaaaactgtggcaaaggtttctacagctgctttctgccacagtggcttgagacagatcaatcgtttcaaagtgtgcaaactggaaagatataagacagagagggacaaggaaccgtctggttaatgatgcaaagagacattaaaaggtaaacacacacacacacacacacacacacacacacacacacttactgacaggcatttgtggcagtcatgatccaatcatttctttggcttgagggctaaaatttatttagcaacatgatttttgttaatgtatcatgtgaccaaaaaatgaaatcaaaataaactttttacagacatttatgtggaattataggaaggcttgagttggtcagctcagaattatttaaacataaaggcttatgctggaaaagataatgagatgtggtctaactagagtcctagagaaacagattgtgataaactcctattttattgggtggcaacctttgcagtgttgctagtcccatccagtttgaggcctgtgcctccttattcactggccatagtagataccatctagccagcagcaggaaatcagtatcatggatacaggcaaggccggtttcaccagtatacaaactgtgcagtcacacagggccccatgttcagaagggcctcacacttagtttaatgctttgttgttgtcatcttaaaattacctcataattttgtctttgagcatgtgttttgtaagtaaagtccaatgggacaacagatcatgcatatgagcagaggagat

SEQ ID NO: 9489 - DNA, 295 bp, artificial
  synthetic oligonucleotide
tccaccatcaccccctgccaccacctcccaacccagtctggaactaaaagtaaaaaggaaatgacaaaagccagtgactgatttttgctacgtaagacctgagatttatgcttagaacacacagttaagagctcagtagacttgtttttggtatctggggcttgaatttgatttctttttaaattttaacaagagaaatcctttttgccaagtattagagggctattgaattccccctcccaccctccccactcccgctctcccttctgcccttcccctcccctctctccccact

SEQ ID NO: 9490 - DNA, 1283 bp, artificial
  synthetic oligonucleotide
gcttgaaaatccttccttatattcagctgaaacctgtctctgttatctctaaccactgtggctgcacagaggaaagtataaccctttccccacttgctagcctttcagatacgggacaggtaaggacacatgtatgaaagcacattgtaagctgtaaagtgatgtgttacctacaacaaggtatttaatattatcattatattttaacctacattataattattatctaacttgtcctttctatctgccacatcttatcttttaaaaactgcatactttgcgttccttctagcgttctttatatgacatgatttccagatatttaaccatcttagttgccttatttgggatatactcaggttcattcatgtctccattaaaatttggccctcaggaattgacttggtcctgtataggcaattgagctagtacagagcacaacaataatataatatttacctctcccctctcttaaaaaatacataccttgtggccgggcgtggtggctcatgcctgtaatcccagcactttgggaggccgaggcgggtggatcacttgaggtcaggagttcaagactagcctggctaacatggggaaaccccatctctactaaaaatacaaaaaattagctgggcgtggtggcatgctcctgtaatcccagctactcgggaggctgaggtatgagaattgcttgaaccccggaggtggaggctgcagtgagccaagattgcaccactgcactccagcctgggcgacagagtgagactctgtctctataaaagaaaaaaaaatacataccttgttaatgaagtggaatattctgccagtttgagggaatattatcattctgttgactgaagagctttttagatgaagtcccattaaactgttttaaccattttaaaacttgcatccacttattttttcactagataatttttgagtcttctttgtgccaggcactatgttgcattctggggatacaatggtgagttctacctttatctccattacctttcagttcctagcctcgcctgttggtatttttggattctagctctatttgaaacacattggctgtgtctccatgttttatatcattcatgaattttatgatcatgtttccgctgtcttttctaacttggtggtatttcagtagtgccaagtacagagccctgaagcattcaagttgatcttctgtgaggctgacattgatccattaattggtattctttaaaaactctttttattttaaaaacaattattgattcagataattatgg

SEQ ID NO: 9491 - DNA, 1637 bp, artificial
  synthetic oligonucleotide
tgttattagtattagatttctactactaattactctgtgggccgaaagctcaggatagacagtttcattctaaggacaaaccttctccccagcaaaaaaaggcactgcaagctggaaatagtgaaacacaatggggcattgcgttttcaaaggcaactgacacgcccagcactgggataggacccgcccgcccagtcctcattaaatatggcagcgagcggggccgacgtactgcggctgcgcaagttgaaactcctcctggcagctcctccccggcgggcctcccctcatctcggctgggtagaggtgccgggtgtgagctcggcgtggcgcgcacgcgcagacgctggctgggctgagccgatactcgcgaggcgccctgtcacatgagccgcgcgcccgcttcgctccccctcctccccggctgggctgtgtgaatgaagctctgccggctacgtggggcgctcactcaacttggtgtcctggacgccagagccgaccgagcgcgctgcccaccggcggcggacacgggctccgccgctccggacctcggcgacaggtaaaggcaaacgggctgtcccttccccaacagtccttggcgggccgctggcccccggcccacccccggagcaccccctaagcgcagcgacacaggggaagcgcaatcccgctggcttggacccccggagatggggcttccccgcgcccggcgttggcagcccggcgcttagaggaggtagacaggctagttccagccagtgctgagcggcgttttcccgggagcccagccctgttctccgagttatggtccctgggttgcccgagcgaagtttccttgcggagcggcgccaagcccgccccgcttttgaatcggagtgtttagccgcctgcgtcccctttcccggactggggtagggtgacttaggctggcaaagctcagccgaggcccggctcttctccctccggctctggacttgccgctggttttgtatgggtcttagcaaagtggagaaactctcggaaaagtagttgctgcgctgttttccttttgccacttaacgcgcgtagctggttctctccagactttcgagccttgctcttgagcgccttgatccacacgggaaaagctttgcctttacattgacgcacgtttcctttgattaacatttcagagcaaatcagttgcctggagttcccagtgaagttgtacctgtgcccgtgcgataacgtcagtggaagctgccccgagtaagtgagggaaatctagaagtttggagcataaaaaaccagcacgaatcaactttacataaacttcatacatttattagcaactgctcgggtttaacttcagggatgttaaatttcgcctagtcccacgggacgatgatcattacttcttaactgcacgcgaaataggagaagaaaaaaggcaaatcaaaacagactgtcccaggtctcagagaagtcatcggagcgctttttcctgctgaattcaccctaggagtttgtgagttcctagttttcttggacttcgcgaacttttccttgtccaaagcactgtcttttctctgttggtgttttgggactggtgtacacattaacccttttgtcattaaagaaggccaacacgattctca

SEQ ID NO: 9492 - DNA, 488 bp, artificial
  synthetic oligonucleotide
gtactagtactaccactactactattaataggaccttacaaatatcagtttttgtgttatcagagaaatatgagggtattgttaaatttgaatcggatgaattaccttttggtgtaattggttctaatattggtgatgcacattttcaagaattcaggtaacattaaacactcagtgaaatcacttagatttttacactgtattgatacatagtttatatttattccaaataagtatttgatcatgtccatttcaatgaattctgggatgaaatgcctatgagcacatctcccttaaaagcaaaggtgaaaattatgctcactgttattttatataagtagtagaagcagaaaattgtgacttataattcttcattgccctctaaaaagattaagtccttatgctggaggaccttttcttctgagtgcaaataaaataaaagcctcagaatggtggcctttcccacacttgaagtagtattaagtatg

SEQ ID NO: 9493 - DNA, 1993 bp, artificial
  synthetic oligonucleotide
tcacctttcccgccttcagattccgacatctttctttcgagattgaagggccatctgcacacaacccccctctcttcccccagctttggagggattaaggccgcagggcggggcaataacagtgttgtatgggagggtggcggtgggggtgcaaatgggacgtttgtgggccagagcctggcaacagatgaaatatttaccaaatatatacctgcagcaaacagtcaaactaaaataagaaaaacgatgtcattttccagtagtatatggaattcgaagtatataggaaaaacctaatatatgtgcaatatctctatggaaaaaagatcaaatattatcaattattattatttttagagacagggtcttgctctgtcacccaggctggagtgcagtggcgtgatcatagctcacagtagcgttgaattcctgtgctcaagtgatcctctgacctcagcctctgtagctgggactgcaggtgtgcactaccatgcccaactattttttttttaaattttgggttgcttcgaactttatttgagaacaacagaagataaacctatcaaaagaacacacaggtgggtgcgggggcacggctagtggcggcggccgggggcatccgggctaaggcttttacttggctgcagactggtcggatttcgcagctcctaggcccccaagctgggcccgtgactccaaggtgatctcgttggactgcgtggctagcttgggcatgggggcctccacggtcagtgtgccctcaggggacagggaggaggagaccttggtggggtccacaccggggggcagcgtgtatttccgggtgaagcatcgggagatgtagccatgctcgtcctgccgctcctcgtgcttgctggtgatctccaccatgccatccttggtcttgaccgtcagctcgtcggaggcgaagtagttgatgtccagggatacgcgccagcggtccgctgtgggccgattctccgagaccccgccgctgagctgccggctgagcgcgtagctgtaggcgggcgcggccaccgcggggctctcgaccgcggcgggggcaggggacgcacgtagcggggccagcagctggtgcccaaccactgcgaccagcccgaaggcctggtcaaagaggcgactgtgcgggtaccagtcgcggaaggggtcccagctggggtcccgcaggagcgagaaggggacgcggcgctcggtcatgctggctggctctgctggggacgtctgcttggacaagtgtcaatttttttttttttttttaagagatggtgtattgctgtattgcccatgccggtctcaaactcctgacctcaagcgatcctcccgccttggcctccaaaactgctgggattgcaggtgcgcgtcggctgttcaagaaatggttacatagatttcttttgctttatttatttatttagagacggagtctcgctctgttgcccaggctggagtgtaatggcgcaatctcagctcactgccaccttcgcttccccagttcaagtgattctcctgcctaagcctcccgagtagctgggactacaggcatgtgccaccatgcctggctaatttttctcattttagtagagagggggtttcaccatgttggccaggctggtctcgaactcctgacctcaggtgatccacccgactcggcctcccaaagtgctgggattacaggcgtgagccactgcacccagccggttacatagatatttgctgtgtaattattctttggagtgtacaaatgtgtatcatattaaagcatttattgaatgcatggacactagtaactataacttacatagtgctttcttatcttatgtgtcaggcacatagtacaacgtgctttatataaattaattctgttttaatcctaaaaagcaggtactgtcaatagtcccattttacagatgaggagactaagacacagggaagtagtcgctttgtgttaaaattctgcccttaatgtgtacac

SEQ ID NO: 9494 - DNA, 1712 bp, artificial
  synthetic oligonucleotide
atgtatatacacctgtcttacttttgtatcttgtttattgcctgtcccttaccccttcgctggaacagagccagagggccacagcctatgtctgccttgctcaccacatagtcctagagtccagagcagtgccaggtacaaggcaggtgctcagtgatcccagtggatgtagcctcgaggtgggagctgggcaggagctacttgcggggggaggtattggccggttccaccctgccccttcctctcccaggtctgttggtatcccagggtgggagcacacctgaaggggtactcgaactcgacctcgatgctgaggtcactctcggtcttgttggcacaatccacgctcagctggagctccccactgtagctgccgcatgtggcaaaggcgaagatggcgaagaccttgggcagcagggatggggatggccacagtgaacctgtgtgcatgtgggagggaggtgccctcctctggacagatcgggggcccagcacaggcagcagcagatggagcagtccccacccccaccccctaatcagggctcatcgggaccaaggacaagctgattacaagggtatggctgtctcttcctgtttctctctctgtgtctctctctgtctctgcctttccatgctgacctccctcttctctgtttgtctctgttgttctctgtgtatctcactgtgtctctgtttctctcggtatctctgtttctctatgtgtctttgtctttctcagatgtctctttgtctctctgtgtctctgatcctctctgcctctgcctatctgatctgtcgatgtctctttttgtctcttttttctctgtctgtgtaagtgtatgcctgtatgtctgtgtctttctgtttcttggtctgtttgtctctgtctctctgtcctgtctctcactcggtctccggatggttctctctctgtctccctcttgcctctgtgtgttggtttctcttttttctgagtgtctctttctctctgtgtctctctctccctcaccctgttttcctgcctctctccctgcgtctgtttctctttgcatctgttttctgtgtctcctttttctttgtttctgtttgtctcttctctcttatgtctgtatctcttctcatctccatatttcttttttttttctcagtatttccatctctgtctttatcattccctgtccctcattctctctgtcaccttcactgtctctgggtttctctgactttgcatctctcacccagcatctgctacaggctccacctcccccacccctccctcacttcaagagaggaggtaggacgtcacagtctcccacttcacaacgggggtaccctcagccctatgtgacgtcacagctcatctgttttctggcttcagacccctgaaacctcaccctggagcccaattcccccatcccctacaacccccgcactcatccctggctactcgcccctactccacccctgctcttctggaccccatgacctccctctctccctgcactctgccccaacagcccggaccacactcacccattgcagcaccttcacaaagccgaggggctccttgaccacccggaactgacccccagccaccagctgaggagagaaacagtggggaaggggtggggttgttggaggtacagggaggtgagcggcaaggctgcccatcaatgaccccaggggatggagcatgtgacctcggggagagg

SEQ ID NO: 9495 - DNA, 2381 bp, artificial
  synthetic oligonucleotide
ctgttttgactttacttgctttgtgatgtggggcaacttctttgcctgtctgcactcagatttctagccaacctcaagcaataactcttggtaatataaatggtgataacaaagactctgtccttaacctccctatacattttttaaaaatttttatttttttgagacaatgtctcactctgttgcccaggctgaaatgtagtggcgcgataacggctcactgcagccttgacctcctggactcacaatcttcccacctcagccgcctgaatagctgaaactacagttgtgcaccaccatacccgctaattaaaaaagaaaaaaaaattgtaggccgggtgcgcagtggctcacgcctgtaatcctagcactttgggaggccaaggtgggcagctcacgaggtcaggagatcaagaccatcctggctaacagtaaagccccgtctctactaaaaatacaaaaaaaattagccgggcgtagtggcacgtgcctgtaatcccagctactcgggaggttgaggcaggagaatcgcttgaacccgggaggcagagattgcagtgagccgagatcatgccactgcactccagccagggcgacagagcaagactgtctcaaaaaaaaaaaaaaaaaaaaagtagagatgggggtctcattatgttgcccaggttagtctcggacgcctaggcttgagcagtcctcctgcctcagcctcccaaagtgctgggattgcaggcgtgagctaccatgcccagctttttgagacaggttctcactgttgcccaggttggagtgcagtggcataatcacagctcactgcagcctctacctcttaggctctggccatcctgccacagcctcccaagtagctgggactacagaagcacaccaccatgcccagctaaattttaatttttttgtagcaataagagtcttgctatattgcccaggttggtctcaaactcctagcctcaagtgatcctctagtctcagcctcccaaagtgttggaattacaggcgtgagccactgcacctgtccttccctgtgctttaatgctgatccagaggtcataagttcaaggaagggcctcagagatcacctcttcagcccacatattcaggaagagtctagcagaattgaaaagtaggccacttctgtcctttgaaatgtacaaggactttacccaggaggctcaaattggcatgagagatgcaacaggctttattgttgcagcaacactaacatatacgccccattccctgctgaggcctgtccccacctcaccccttggttgtcgatggtgtggaacattggggtgaggggcaaaatgcctaagcagagctggagggaggcaaatgggactggtgagggtcgggatcacctggaccaggggtccaacagtcaggatacccgactccatccacacaggggcatggaacacttgggttctgagttcaagatttggcaatgtcttgacctgggttggaaggtagggtggggtctggaaaagctttggtccagggttcaagatttgagagtgccttgctccaggccccagtttggggatgagcatggagaagggtggatgggagtgtctctgggttcacaatttgaaattggccatggatgctctggcctgaagccccagttttggggctggatgtaggtggctcttggtcctaggttcaaggctggggaagactcttgtccctaggtaatgggggctgggtgtgagggatatcttagtttggggctggcgtgggggtagggcggtcacagatgtcctgttttgtttgggcagggggctctaggctcctgttttaagtgctgggaaagggctctgggtcccaattatgggctgggggtggggtggtattctccaggtcctgggtacagatcccaggggcctaggatccagcctcctgctcttgtcccagtgcctctagtagcaggcccattggcgtccgcttgagaccaatgctctcgatcttgttctcaatcttgttcttaaggttgcgcaggcgcaacgaggcgtgcaccaggatcactgtgggcggcaccgagaggggtggtcagtggaatagacctcagcctgcagccaaccggggcccaccgaagggaattggcgcgcaggcaggccaatggagtggtgagcagccaggacgcctcagatactgaaagcgtggccgagtaattggcttggcaacgtgggcatggccagggaagacgcccggtaacggggacgtggccagtggaaggcacttaacaccaagagtgagataggaaaggcgataataaaaggggtgttcccagaagggggaacgaagcccgggaaggcgcttttagcgggggcgtggcgaggccctcgggtttcccagccccc

SEQ ID NO: 9496 - DNA, 1564 bp, artificial
  synthetic oligonucleotide
tattacatccccgtttcatgggtggactcgtcgctagggaagtctttgccgacagaaaatcacccttccgcggtattcctttaatgagaatgggtaacttaataaccatagaaatgaaagcggaagcttcgctctggtcttgttcccgcccctcctccgggagaccccaaaggggaatcccacctcttgtaaagcctttggccttttttttttttttttttttaaggtttgacacttattttgttatcatgatactgcatgtcacgttaggtaaaggacttagccaccaataaaaatagcagagtggaaagagtgacagtgaatcaaacgaaaaagctacattaaaacaaaacaaaaacaaaaaacaaaccagggtggtgaaacaccaggctcattcaagtattagaattcactataaccctcaccgatctgagagtaagaaatggtatctcagtgtagtttttttcttattttcttttttctttctgtttttgttgttgttgttgttgttgtttttcttttttgagacggagtttcacttttgttgcccaggctggagtgcagtggcacgatatccgatcacagcaacctccgcttggcgagttcaagcgattctcctgcctcagcctcccgagtagctgggattacaggcacccgccacctcgtccgggtaatttttttttttttttttagtagagacggggtttctccatattggtcaggccggtctcgaactcccgacctcaggtagtccgcccgcctcggcctcccagagtgctgggattaaggcgtgagccaccgcgcccagccttcttattttcgtagaatttaatgatttccctgctgtggaaaaatatttccagcagggccgggcgcggtggctcacgcctgtaatcccagcactttgggaggccaaggagggctgttcacttgcggtcaggagttcgagactaacctggccaacatggtgaaaccccatctctactaaaaacacaaaaattggccgggtgtggtggtgggcgcctgtaatcccagctactcggaaggctgaggcacgagaatcgcttgaacccgccaggcagaggttgcggtgagccgagatcgcaccactacactccagcctgggggatagagcgagactctgtctccaagaaaagaaagaaaaagaaaagtattgccagccaggactctttgatttctttcttgatttaattgactttattgaaagataacgctattgatctgtctatatacataaatgcacccattttaagggtacaatttagtgagctttgtctaatgtatacaaccttgtaaccaccatcacaagcaagatagggaacattgatttctttgtatcctatcccaaaccccaccccctatcccaggtaaccaatgattggcttcctgttactggattacatttctcttgcagagtttcatgcaaatagaatgagacaggatgtatccttttctgtctggcttctttcactcatcataatccttttgagattcatccaagttgtttcgtgtataagtatctttttttctttttattgactag

SEQ ID NO: 9497 - DNA, 3340 bp, artificial
  synthetic oligonucleotide
ctcagagttccctgccagaatgtgcctgtctgccaaagagtgtgcctgtactggggcctcccgaccctcagtgccctctccctttctctccgctctctccttttctcttccccacatcaggaggtgttcatgtgtgcctgcgacatcccagccagcacctcaagctctactcacgtgccccacaaagccaccccttggccctcaggaggatggtcccttggaagatgatggtgcaggccctgaaagtggcctcaaagcctgggatccccatacccaagtgaggcctaaaagggggacacaagatccgcgattgtccatgtggatgtcttcccctccacccctaggagagacatagactgagcaggtgattgctctaaagtgcaggacccagggtagagtctcctctctcctggtctaagggcaaccaccaccgcggggaaccaccagcccctagaaactgccactcacacagacaagcacagagctgcttcagatcatgtttattgtggggccagggggtagggatcctcgggtgagagggctggctggccggggtaagttgctctggacgtgctggcggggagcagtcctggtggcgggatggcgggggcacttctgggtcccagggtgcacgggatccgggcagtgctcagggtggcaagaggcggcgtgcaggcacctggggcgccggggtctctaggcgtttcacacgcagcagcgcccccagcacgccctcagggggcagctcagagcccacatcgtggtcggcggcacggcggaggcggcgcggggctgccaccccctcggagtccgcgcttcccgcaagaatccgtcccagcaagtacctgcagggccgagcgcaaagcagtgaggcggtgtccgcggtggggcgttcccccgccccacgctcggggcccagaacgcaggatccacaaccacatactgcctggggacacggttccctccccaagaaggcgtcctcagcccactgctttcagtagacagccgtcatcgcctttcatcccagaaaactgtggcttccccgcctccctctccccttcccaggacctggggtccacttcccccactgagtcagccaggcatccttgcctggactccctggatccaggacctcactccctcttaggccccaggacttaggggttcgcactccacggggtaagcaggcttcccagttcctcgccctcgtcctctccggacgcaggcgcccgacccctccccaccccctgccgggcacctcaacagctcggggtccacgtcgggtgtctcgtcgcctgcctcctcagcatccgggcccgcggggccgtcgtcgtagaccgggggccggggtcggagcgccgcggcggggacgggcgcggggacaagctgggctgcgagggcggcagggtcaaggcgggcgcggagcagagcgcgagcgagctgcgctgcaggcgcgtcggggtcgtcgtccaggcccagagccggatcagagttgcggggggcgccccagacgcgcagcagctgcgccaggacgcgcgcctgctgatcctcagcctcctgcgcctcggcccgcgcccgctcctgacgttcggcctccagcagatgcgccagcgcccgcgccagctcctgcaccgcccccgccgcctcacctcggggcactgaccgccggaagcggcgaggagcgccagtctcagccaagggcggagacgctgcgcttaggccgcggggctcctgcgggaaaatgaggtgggggaaaagagtttgtcagcgtccgtcgagacagggacccccagcccgggaagcttcgtaggcctcaaacatcccagatgccaccaaaagcaccgtgaccatccaaatatacccggacacccctaaggccactggaaaccaccaaatatctccagacgcacttaagaccaccaaagatccccagacaccccccacccccaccccacagcgcgccagtgatcccttggtgactctcataattcctccctccccacccccactcctggagaccgagtttcttcataagagtagtgatggtagatatgacagttatagatttttccatatttaatattgtggacaataggaactatatgaataaacttgttcatatatcatttggcatgtgtacaagttcatctgtagaataaattacccaatgacaaattttcagttcaagcagttttcaaacaatttccacaagtttaaagaaataaaagagggtaccaataatctgagcaaggaataaaagatcataaaaatgactgtgaaggtttggaaaagaaacatacaggccacatataaatatgtttaaaaggagtgatgcctgcaacacaaatagtcaatgaaagagtagtacacagaagatacagagaattcctaaaaagtagtaagagaaaaacaaactcatacagaaatagaaaaaatacatgatcgcctatttcacaaaaatgattactaaacatatgaaaaattgggccaggtgtagtggttcatgcctgtaatcccagcactttgggaggccaaggcaggaagatcgcttgaggccaggagtttgagaccagcctggtcaaaatggcgagaccctgtctctacaaaaaataaaaccaaaaaaaatgagcggggcacaagcccatagtcccagctacttgggaagatgaggtgggaggatcacctgagtccagaagctcaaggttgcagtgagcccagatcgcaccactgcactccagcgtgcatgacagaggaagaccctgtctctaacaaacataaaataaaattaaaaacctcattagtaatcaggggaaagcaaattaaaatgccagggagatactatgcataatataaccaaaagattgacccaaatcaaaaagtctgataatatgaagtgttgatatgaatgcagaaaaatgggaactctcatactatgctggtgagaattaaactggcaaagtaattttgcagagcggtttgacaatatctaaaaagatgcacatatcctatgacccactcctgggatgtcactccccagagcagctttggcacatacgctactggtcacaagttcgtgaaagatgacagcagcactgttcgtaatagcataaaagggcgggggagaaagaaaagcctggaaacagtccaatgtccactgacaaattgagaatacatatataaatcatgatgtcctcataggatgtaatattatgcagcaataaaaataaatgaattacagccacatgcatcaacttggatgaatctcgtgaccagaatagagccaagggaaaaaaaaacgtcaagttccagaatttcactgcagactgcctgagactactag

SEQ ID NO: 9498 - DNA, 1538 bp, artificial
  synthetic oligonucleotide
ttcagtggattcatttgaagcgagggccactggtatttgaaatagatgacatcatctgccagcagaggcgtgaggcaacttgaggcggggtgtgggcctgacgtcatcacgcagcctcttcctttccccgcccccttctcttggcgaacgaggcgtcagtttaacacctccgtgaatccggaagtatgctgtcaaaacaaccaaaccacggggctgggggaggcggggcctcagtaggcgtctgcacgctagctgaaatagagcaaaatgcccgacttttgggggcggggctcctggcaacagcactctaggcgcaggcgcagaggcgacctccaggcagggccaggtgggagggacggtggggggtagggtcgcgcggcgccctctgcgcctgcgccccggcacgaggtggggcggcgggcgtcagtacagtagagtgtgcgccggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaaggtgaggctggcggtgagtcggcccagccgccgaggcatcccaggggagggggaggcggtggctgtcataggatggagggcgggacctgagatttcggacataacctgagcggcgaagcttgagggccaagtgatgatggcgaggggtagggagggcctgagagcctgagagcgttagcgacgtaccttggggcgtgggactgaaaatagagggacgaggcgggggtctatgggatgaatgggtggagcttatagacaaaggggaggggctatggggctggaggaggggccgcagtagttgagggtggggctctgaggaatgagaaggtgctggctctggagtcagtcaacccatgtgttgagagtgcacttatgtgcaagttcccactttgatgagctgacaggctcgtgggtggagacaactaaagaaatgagatgcttcggacactaaaataatgaaaaaggttatgaaatagggagtcacgttagccaaggttgtacagggaaatccccagaggaggtattgaaggagcagagacccgaataaaaggagtcagccatgtgcatattagaagggaagagtattctaggcagaaggaatagcaagggcaaagactagaggatgggaatgagcctggcatgttcccgtaggttcctgattgctggagtggagagaatgaggggaagagtggtaggaggtgaatcagagcgctaagacagagacagatcgccaagggcctttggtgtgtatgctgaggaagaacgctgttgccatagttccagtaaacaatgatggtggctccgaccaaccagtggcactggcagtgataagagggtccacacatcacttcagtgtaatagagctctaaggtagaagtttgacattcagaaaaaagatgatgcctgagctgggcgtgaacca

SEQ ID NO: 9499 - DNA, 595 bp, artificial
  synthetic oligonucleotide
gttaactggtaaattcggtccatttacatttctcatgataataaactatttgaatttgattttattatctcattctgtactttctatttgtccaggtttttctgttccttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctgtgagtcctgatttctttcatatgctgtgggatgggatttgctgggcagggatcggcttgcatgtttacctatccacctattcttcttccattgatttattttaaatttttatttaatcttttaaa

SEQ ID NO: 9500 - DNA, 1100 bp, artificial
  synthetic oligonucleotide
tggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagctttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttctttgtgtctgtgttactgatctttgtattaaagggtaaattcagctagtaacaattttctctaccccggtggggttgagacactctgtgtttctgtatatgatatgccaaacacttcatggtttatggattgggaagtgaaagctgaagactaagttctgtgctgaatactgttgatcctcacaacactaatataagggacagggagggcaacttaatgtcatagacagaatttcagaaacgaagaagccccagtgtgacatctttgttccacgtctactgaactttcatgttctaacttcacaattgagtatcatcaattgtgggcaatatgggcaattgtgggcaattgtgagcaattgtgggcatatatgctcatgcttctgtgatagcccttgttctaaatgagtcaaccggttacgatctc

SEQ ID NO: 9501 - DNA, 1470 bp, artificial
  synthetic oligonucleotide
atgtaaagtggctgattacaattttggagtgtatttcctgagaccccttacccctttctgaccttgtaattcatcattgacgttaacataataatgatgattgaggtaataaagcctagatctttaacatatgaagttcagagaccatagcagaggctgctggtgccctaccatcccttccgtgttcacccggacatgcaaaaggctgcttgctgcaaaaacctgctactattactctctgtctgagggctttttttcccctgtggtcaaagaggcaagctctccttgtgtctaggataaggtccccagaagtagcctttaaccaatgactgatgggaagttgatggataaaaacaccccaacttctttgactgtcaaattatgtatctctaagacgtgactttgcatttccagcaagttcccatgtgatgcttatcctgctggccagggactacactgtgagagccactgtactaaagacattgaaccacatcaaggactgaagcattttaggatttgatcacgtgttcttttcatagaataattttctaaaatctatttttacttatgcctcctacccacggaagtcaattacttgaaataacttgtagggaaaaaaaaacttttcatttatattttatcttagccattcccttactgtgattttgattttcttgctgtcagggttaaccgttttggtaggcctaaactaccattaaaagtcgttagtggtataaattttctaataattcagaaaaattctattgtattatttgtgaatctaattgagttaatgagttttattctacaaataatatttataataataggtctttcataaacataagcacaaattctttcattagtacatttttcctgtatgtcaacattttaaataaagtacatatgtgaattttatggcattttttcatttgtgatcatatatttctttaagggaaatagcacatcacttcagattcctgttaattttacctgctgtcatctcctacttaaatgagtcatgtcaagtattacgtgctgcttctcctgacaagtacctgaaagttggagcaattttcacacactctgtcctattcttctgtcatagttcttcaatgcattatgggcaggaaatgactttgactgatgagaagagttagtgggaggatgttcaaatcaaatggcacttatccttgccctccacccccttatctctaagaactccccacagatggcttacgttgtcctgggctggtttatggtatagcaccattctctgctaagctcttgaacaccagctcatctgcttaattccaggtcttctctatccgttctgggctctcctatcctcttccccattgctgtgcttcacttctcccttttttcaaataaaactaacatatggcttttgtgtgtggccgatttctaaatcttggaaataacagggaagggaaaaaatggtgacaaccc

SEQ ID NO: 9502 - DNA, 692 bp, artificial
  synthetic oligonucleotide
ctcaccaaagttgtaaatgtttagatgaccagtatccaaatatagctacaaaggtaatagtcaatgttagagaagacttctgtaaaatacaaattactttaaaaattaacctagttataattacattctttgtactcaaatggacatgctattttttggtgtttcaaattaatccacatgttctatatctgaataattatcttcaaagtatacttgtgaagcatatgcattgttttaattttatattatcaactacttttaagcttatatttaatttctttgtagtgctttaggctatatgttaagaatacttataggtgatacattttttaacacttgcctaaaatattctaaaacttactactcttatggcagaagttaaaaggaacaggattaaggaaactattcattcttcagcttaagtttagatcagatatccagtattacagatagttatttttttatgagaacacaatcatactgccgtgtgatggtgtggaaacaatgtgggagtcatactacagaaacacagatgatttgtgtctagattatgtagatctcaagggcaatcacagtctcctctattccacagcacctgctctctgacactgataggtaggcttgggaaaggacttctcttcagtatctacggtaagacactcaggtctgagccctcgggggtaaataactgg

SEQ ID NO: 9503 - DNA, 2325 bp, artificial
  synthetic oligonucleotide
ggaatgggtatggctgggttccaataaaactttatttataaaaacaggtggccagctagatttggcccacgagccattatttgtagactaccataatacattactaccataatactacctattaccaaatgaagattgtaaggaaaagactactgagagataaagctagaatttggaattatatgggaaaattaacaattattttcataaatattaggaattcactgaagacactggagcacatggaaactgaattgcacctgaggaagatcaatgtggaaagtgttatgcaggatagactggagaaggcagagaatataggtttggaaaatacatagcagattatttaagctgatggccttgcctcagatttgactgagaaaacagaagtgatcatatccgatccacttgatcttctcaccaacaaacatacacaactacctatatttgtacccaagttctcatttgcctgttaaaatgtaggatgtgtttttcctgttaccaaagaccactctctatgccggcccctcctgttttgcaagagctttgcaactttccttatactttctctcttctgtgctctctctccaggactactggctcattcattaccatataaatgtgctccaatattttctattgagcccacatccccctctagctgccagaccatttctctgctccactttatcagcaaatagacaaaggaattatctgctcatcttatctcctcttcaatccctcattccccattcataactcaactcttaacactctggcttcttccctgatcttcccctagaactgctcttgtcgaggtcaccagtaaactccattataccaaatccattggatacttctttgagctattttcccttgatctttgagcggtactttgcattcacgacactacgctgccctaatttcccacctcctgccttactggctgaaaaagctgaggaaggcttctttgctggctcttccttctctacccctcaaatgttagatgttcttagggatacattctgggccctcttctcttctgactctaccctctagcaggtgatttcaccaacatccatggattttattattattttaaatagagagagggggtcttgctgtgttgcccaggctggtctcaaactcctagcttcaagcaatcctcctacctcagcctctcaaaatactgggattataggcataagttaccatgcccatctcttttaaataccatctctatgttgatggcttccaaatttatatttctagtccagggctctcttctaaactttaggcttgtgtttcaacaatcagcttgatatttctacttggatgcctcacagatctcaaatttcttcctcaaacgtgttcttagtttgaggcttagttcttaaatttcttcctcaaatgtgtcaagcttcctcttgcttaggaatcatccttgattcctcactttaattcacacgtatgtgtggtgcattaataagtttagcaagtccggttggtttttatgtctataatgtatttcacatcttccctcttttctttttcttttctccatctccactgcaaacaccttggtccatacactatcatctcctgcaaagggctcacaagtattcttcctatttctagtctggcctctgtataatctatatggaggtagaagtgatcataatcatctcaaagtagaaataggattggaacacatcagtctactgcttaaaatcttttaatgactttctatctcacttaagaaaaacattcatatcacgtaggtctctcacggcctataaaaccgtaaataatttttcaccatctctttctccaatactgctttatcttaccctttccctcactttctagccccactggttgtccttttcttcttaactgcctccaaacctttgtctatattattttctttgcctgaaatacatctagtctccctgtgtagccatctctttcttatcctttagcttaaatgacaactccttagtaagatatatcctgatccactttcctccattataaagattgaagtctgtgaatgatttagaaaaagttaaagtatatgttagatacaacttccaaaatgttttcttaagagagtgttagcagtcacaaaaagacaagagatggcatttccttttgatctagctacaaaatcatgcatattttcacattcaaatctctgggactgagaaacaattttccctaaaccataaatgtattttttccttgtacacactacatactgcttgccagaatctactactttttccatgtccagggctgaagagtaccattagacattgatct

SEQ ID NO: 9504 - DNA, 1870 bp, artificial
  synthetic oligonucleotide
atcactcttggcatttagagtcttttgtatttttgaagtacttaacagtcatttattgttttatcttattttcatcttaaatgggataggttggttagcataacagggtcacagaaggacaataaaagattagaaacttgtaacgttagacagttgtactgagggagaacaaagttcctggctttcacattatttaggcaaaaagagaaaagaagaaagaagaaaacacatcataggtcttcagtaagaagcactgtttcctttttattttccactagtttagacgacaagagtgtgatttctttgtttgttgttttttgtctttttttattctttattttattttatttaaatttattattttcttaaatttcacttttttttttttttttttttttaatggagatggtgtctcgctctgtcgcccaggctagagagcagtggcactatctcggctcactgcaacctccgcctcccgggttcaagcaattctcctgcctcagcctctcgatgcatagctgggattacaggtgtccgccaccatgcctggctaatttttgtatttttagtagagccggggtttcaccacgttggtcaggctagtctcgaactcctgacctcgtgatccgcccgcctcaaagtgctgggattacaggcgtgagccaccatgcccagcctgaatttcacttttaatacagctctggagtggggtgggggtatgaaagaaagacggacacctcaacacttttatttgtaggaaagtgattagaataagccaagaactgagccagggatggggcctctcaccacatgtgccaatggtagtagttaacaaaagctaacatttattgaacactgagctaggtactgtgctacagtactctctattcattattacatttcatactcacaacaaagctatgagtaggagctgctagtactgcttgccagatgattcgcttacttcttaatggtaatacattgcataacaatgaaggtgacctggaaatccatgaactccttggttccctggaagaaatggtgaactccagttgaaaaattctggaggaataaatcaataatggtgaatatgtagcacctatgacctaggctccaaacactcaacaaagccccatgaaaagggcttgtttctcttgaatcttgaagacaggattcccatggtctatcttccagaccctaaataggtcccatctttacaggccacagagttgttaccagtggagcagccttgagagaagaaggctgtgtttaatcattagcttaaggtgagggcagagcccctgcttagtagatatagcccaataaagcaatcaatagcaggtcaagagcacctcccaagtagggtctgaagagaggcaccaactacaaagatggtttcaagtttcaccaaaaagtagaaatgggcagagaaggcattcaccaagcagtgacttttgaagccatccaagacatgtttcctgggctcaaggggagaatattgccatgaaaattattactgggacagtgctcctagaccaaaccctggtcagtagaaagcaatgaaaatgatctcatgggatccccatcactcaggtcctgggagtgtctggtagtcacagggagcattagggctgattgttgagacactggtgaactttgaacctctgtgatttccctgtttgctctgtgcctgatagctttcagtctgctaacaaatctcctttatgcagtttaacctctgtacttccaatggggaggaattggaatcagcctatgggagaagagatagctctaggattctgtgtgggaacttgaagagataaaagggcatccttgaaagagaacctcgtgctttgcatctcaactgcct

SEQ ID NO: 9505 - DNA, 334 bp, artificial
  synthetic oligonucleotide
ttagcttggctttatgaataacagaagatgtgaagagagtgagattcttgctaaaatattctttaactcagcaactaaatctctgtcttcttttctgtctctgggcctgttgcttcttttgttaattagtaataattttattatataaacttaaagtactttagatttagttaaattctcattggcaaatcaaagcatgccatatttatcatctttggctcaaatatcatccctgagtggcaggcagatggcagactgtgttatcctctatcagttgaaaaggaaacccctggaagtaagttaatattttgggctttagcagaaagctgggact

SEQ ID NO: 9506 - DNA, 787 bp, artificial
  synthetic oligonucleotide
aaagggaacatctgtgcattattgtttgtgacagtggctttgttacagcaagtgaaacatctggagagacttgattacttgtcgacagaaacttcaatgcaatacataggtgaatgataatgtattcccactgggttcaaatgaataagcccagccgatggggtcaacctaaactaatattctggagcaccacagtatttgaacccttttattctgagacattccttgtggtgagtctgtatctgcagccattttgggtactacctaacttaaaagaagaattaagaccttttccctgtggcttttacactaagtatcagatgtggcccattcactctcattcttaggttaattctctgctagaaacaaagaaaattgaagtctcaataatccagactgtttgaacccatattaatagcatttttcagtccttcttttcaatacagagtttcagttcccttggttgttagagttagtcggatagttagttgggtagctgttatttgccaaggaacaactttagggctgcagagatcaataggtgaacaactagcttctaagaccatagaagataattcattgaccattctaactttattacagcttaattaggtaaaaagtgtaatgtctgtgagtgcctaacaaagtgctagacatgtgctaagaatacaataaaaattgaatctaagtgtggcagacactactggttatacgcacaaaggctatttcctcctcctttcttgaaggcagagaacctctcttcccagagattgaaaatactaacttc

SEQ ID NO: 9507 - DNA, 1038 bp, artificial
  synthetic oligonucleotide
ggccaatcagcgtcacagtaacacgtaaagatagagtagcctacagagagacttgtgaccaggaaactcctttggagatcaggaaactaggtaggcatcccctaactagccttgaggatccaacttggattgttgcctcagttggcaaaactcactaggctgaaagtcttcagtttccaatattcaaatcaaagtaggagtagtttctctggatttttttttcttttagcatttagcaggagtaaggagttggtccatgattaactccatcactggtctatttatgacctactttaatttttcgttctatttatttggttagtttgaatactgtaataggcaactgcaaatccacagccccaaacaaaagacaggaccttggtaatgaccacagctaactgtatgtttccctcatcgttccatcttctggcctctccctacctcgtgcagaggtatttttgaacattacataaaaccctcaaaaaggactatcgaccccaagtaagtatgaatttgtgctaggcaagtagaaaagaatattgatttcattctctttatgtcctattacttccagggaggcagacaaatgttaaaacgataagttgtgtgaatcatgtgaatatacattcttctgggacaaagcaattgcagagtctttatagttttttcatatgtaactactcattccctttagaaggatttctagcaaaaatatagcttatgcaacaacagacttcaagatgatccaggctatctgagaaacctattccttgatgataaaatcgaatggtaacacaaagtttaaatgcctcttcagtatgttttgctacaaaaatcgcttagttttcaatttaaccatgcatttaatcctttggtgaactgagtaatgccaggacagagtgtaaaggaactggaacatcatgagtttgagaaaaggacaataaatccaatattgcaaaattacagtagatggtgctagatgggtgcaaaagactccaacagccatctgggccaccttcaagatttctcctgagctta

SEQ ID NO: 9508 - DNA, 1256 bp, artificial
  synthetic oligonucleotide
aacgagactgtatctgagactaggtgttagttaatggagaactaaggagtcctatgaaccctgcgaggtggctactgagatccccgcctggcagagcaggctgatggagcagtgagggcaccagctataatgttctgtgattctctaccacacttaggacctgcagagacacacagcctctccacttcagctccactggctcccatggtacactttggctctaccaggcatgctcttgccttaagacatttgtgctcactgtcctctctacctgggtccctcttaccctagagagccttctggcaggcttcattctctcatttcttcacatctttgctctaaagtaacttcaccttcaggaacttttgcctgaccaccctactacaaattgcaaccctccccactctccatgctaatgtagttttactatagtgggcattgccgtctaccttcctacataacttactaatgagagggtaagtgtcactggggcagagatttgctttatatgtactctggtgtatccaagtggtggcacctagcgggcactcattgtggcctttgcctttcttcactccacaggacaccattggcactgcattccctgttgaatgacgccccctggaacacagctttatagacttcaatgtgaatagtgccccctagaattgttcaagttggcagtacagagcctaatatttgttgaaaagaggccacaggcgatctactctctctgctcatcttcctgatccagtggcctctgaaatccttctggcggcttctaattgtaaaccttctcatacttgaaaccttccctgtgtcaggatgaggaagctcgtatgaagagtgggctgattccatttgtttgcagtttatgatcaaatttggacatcttatttcgaagcgatataagaaaggcacttgataagctgtctgcagcagtttctcctaaggggtctgccaaaaacggtgtgggatttcagggtctggttttctttgccttctccaggtaagcttgtttataaagaggaaacatttgtgccgctcagcagatttgagagacccggtgggaattgctgtttatttgtcttttgatcacaaagcctggggtttggctccaaggctgaaggtctcgaggcctctttatctcctccccttgagactttaatctctcctctgacattcctttggcccgtgaggtggctggggagttgaaggagggggagtactgcaggtggacaaagattccctggcct

SEQ ID NO: 9509 - DNA, 1424 bp, artificial
  synthetic oligonucleotide
caaaggccctatctccaaatttcattatactgggggttagagcttcaacatatgaatttgtgggggaaccaattcactccatagaaactgggaaaacagaagcacagagaaattaaataaacttcccaagggtacacagctactaagcagagggaccaggattcaagctcaactctggctctaaagccccaagtatctttctatacaagactttgatcccctcattaatgggtagataaactttgcatgctaaaaagcatcaagtacttttttctgtgtaacaatgactccaatgctgagtggcttacaacaatgattcattatttctcccaattctgtgggttggcttcaggttcttctgttggtcttgccttgactccctcacgtggctgaattcagttggagggttgtcttggggttggattcagggaggatagctggggcagtcgatcatccgtttgcatgcggtccttcatcctatatgaatggtggtctcagagcatggtggtttcagggtatcaagagagtggggctggatgctgcaaatttttttgaggtctagcttcagatgttgtacaacatgacttccactacattctattggccaaatcaaatcacaaggtcagctcagattcaagggaggagaagaataggctctacctcttgaaaggtgtaaaatcatattttgctataaaatcacagtgcaaagaagtgttcatagtgggacaggagaaatttgtagttgttaaactatataccacagatagatcaaacctggacactagatagtacctaacacatctctgttatggagaactcttgcttgcacatgacagaattccagctcaaactgggttatcaagaaaaacgaggagccaggcatggcggttcatgcctgtaatcccaacactttgggaggccaaagggagaagaccacttgaggccaggagtttgagaccagcctgggcaacataatgagacctgacctcgactttacaaataataataatagtccaatgtggtggtgcacactggtagtcccagctacttgggaggctgaggcagaaaaatggcttgagcccagaagtttgaggatgcagtgagctattattataccactgcgttccagcctggccaacagagcaagactgtctcaaaaaacttaaataaataaaaaattaaaataattagaataattttaaaaagaaaaaggagggaacattttactgggtcactttccttttaaacacaagggttagtctggctttagtcatcagcacttggtcttttgttctttccttctctcagatgagaccacctccttatagaggtaaattggagactagcagcttgattcttacaatcccaccacaggaaacttttttcccaaagttttccagcaatatcccaagatctcattggtc

SEQ ID NO: 9510 - DNA, 1199 bp, artificial
  synthetic oligonucleotide
tttaatggaggaagtttggggcactgtcttagtttgagttccccgagaagcagatcttctaacaaagatttgagtgtaagtagttcaattgaaagtggatttcagggcgcactgatagagggatggagacagggaaagaaagaacacccacataaggtgtgttatcaaacaagtgaaaactgtgggagatgaaatctcaatcctgctgaggacttctggttggcagtatagaacatgtcccagaggtatcccacttaagggatgaagaaacttaggtactcatctgtcgaccccactggttgaggactgcttcccaggatataaagtctctggcacttccagctcatcttgtttgaggcctaaacatgctcctgtgaccagaataaaagccctcaggcagagctcagcaggtgttcagtgtaagtgcctgcaggatacaggagagaatgccaaggggaggaagggagggtagcaatagtgtctgctgcaggcagctgaacatcatctgaacttacaagaatgagtctgtaactattaaactcaaggacacctctaagctcaggggcaggcagttgggttgggacatcttgaggcatgggctccagtacagtttacctggcactcctaaggtgagccctaaccaaagtagggttttcagaatttctctctctcctttctccagagcccctcattcacaaatgtgagaattctctgcaatctatcttcttcctgttctgtgagtcaactctaaaagccatgatttttcagccccatgttaccccttgaggtcaccttcaccctagcaaaattggtgattccttgaggaggctgggagaaggcaccttgcaagtttcacaacttgattggtggtggaatttttttctccctcttcccatatttaatgtggctctaattctgacttcattgcagagcggtgaaatcaaattaggaaatgggaggagatgagcaaccccttcaagcacaatcaacttctgatggcttccccaaagctctaatgaatctgcatagacttccagtaatagaaggctgtttcttcgcagcactttgtttttctccatttctaaagagaaaacaagccagagtataggtacgcagggagtcaatgcaacaaggttggtggaaagccttggcttttcacagctgagtgggaaagccttggaggagggcaagtaggctga

SEQ ID NO: 9511 - DNA, 1859 bp, artificial
  synthetic oligonucleotide
ttctcttgaggatataattcattgattatcttttctttgagagttattcacatttttctgcatcttcatatattgagtaattttggatcatatcctggacattgtgaatgttatggggactgtggtctctgttatattcctccaaagattatttctctttttaaaaagacaattaaattggttggactcaaactgcaaagtctgctttttaggtgctaactcaaatctcagtgtaatttttttgtccctacctgggatactttgagtcttccctgtacatgtgattcagggatcagatggagatttgggcaaaatatatacactgaatttagatgctcttctctagcccactactttctaggatttttgcctcattttctaatgactatgggttcaggttgccctgaaccattcatgctgggaagattggattttctataggagtttcagcagccccttgcagcatcatctattgtctaatctcagactaaacgctactattgtctaatctcagactaacagctgtaaaaatcagaagctcatccatttttttccccctgcttccctagattgactccacggcaggatctgcttatttttgctgccttccagggccttcaggtagttattttctttttgtattttgttcagaccatgtagctgatatctgtggcagagttagtcaagtaggagcttaggagcttattcagccatactgggagcaggactaccttttcttgatttttgaaatgatgtgagttcaacctttcctgtggttttctctaaaagaatgctaatttacattgcaggtcacagcctttgattgatttttctgtgtgggccaatgaccttcaatagagacagagttctatagctcagtcatagggaaggatgtcacatcaagcttcatttccatttttttcaacaaaatttactgtcatcctgtcatgagaaaagcactagattgcctgttctgtttatctagggggcatccttgagctttgtgggaagagggcaaacttgaccttcagaaagattatatggctaagagaaaaaaagttttacccttaagaaacactgatttcgtatcaggtgattattttatggattctttcttgtttaaccctcacaactctgccagatggctattattgtccactttttatggatgacagaggtgaatctgaaaggttgtacagctggtaatttttataggcttttaattttaaaaatgagttaatactaaaagaattaaattggcatattactgtgttctcaaaaataatattaataatgataatgataatacaaataacaatatccaagtgttacttttcctcctagcaaaaagggattgtgacacagtacagtccctgacttttgactgacaaggttctatagtgctaagtatagttttctattaagattgaaacctatgagaaaaaagccgtgggctgacccatcttcaaagtgtccatttaagattattttctgtcagccaggtggctaatgggctgtgttagacaatggatagatattgtattctgtctgaaaccatagaattggagaaaaaaagagcaattccgcatttatttggcttgtctactgcccaggagcccaagctacagagaacatttatttcattttaacaaatggatggtacctccctattttaggctggaagaaaacctctgctctggcctcagtgtgaacagaggcattggtgatggaatatccagtgtgagtcattgtccccacactgggcaaaaaatagtgaaagcattccggggcaattctaaggaaaaatgttcagttaatggtgggtttatctaatgctggatttgaaaaaaaatattgac

SEQ ID NO: 9512 - DNA, 1558 bp, artificial
  synthetic oligonucleotide
gcccaaagtcacatagctaactattgagatagtaaggtggggaatccaccatattatcctagcaacatacttgtaaacattcttaactcatcagaaagagaagaaagaactaatatttgttgttgtcctttccttggccagatgtaatttgagtgtcttcacactgtcttattattctatgtgaatcccccaccatacacatacaatatcaagaggtgggtaagattactgtcattttacaagtgagaaaactgaggtacagagatttaagtttcttcccaaagatcacaaagctactatagcagaaaacagctcagcttaaaagagtcctgatatggaaagcacttgcaatggtgcctatgacattggtcagctcggagaagattctacagatagctaacgccatgcataccaggcaggttttttaccacattccctttcagagactgacattttgtgacattgatccccaaatctagaggagacagatttccctgcacaaattacatgcatgtggataggcgggaaaagaatacccagtggtgtggcagttgcgatgtcatcatccatgtgagctctatgctggtatgtgcggatgtgaacaggagcattgtgtactcaaaggcacgtgtgtgagtgtgtgtgtgtgtgtgtgtgtgtgtgtcttttcacatagatgatctcagaactgtaggactattatttctggggccctaccctggtgctgtgtaaacacatcacaataaaaagaagtgacagaatcttctggtcacatcgaaccatgcggatgtgtacccagcatggccacaatttcagcagagcatgcaatactacttctctgaacataaaatggcagaggagcctggacactagtgtctagggtaactgaccatacaccagaacagacacttgcccctatgttctctctaagtagtattaattcacacaccctgatcagtcctgttacttgtcctggctccctgtgtgctcaaagcagctttatttagtaacacctgggggatccttgaggataacccaaatatgccactgtggcatatcccaaagtggcatatttgtgagtggcatattctactacccttcagaggcaacattaaaaccatgtggaagaccactgcatgggaaagaggtgcaaatccaaaacctttgcatggggaagagaaataggctaatcattgaatataagcataactacataatttttaaaccatcgcagaggaatccataaacaatgggaaagaacaaaaatacgttgggaaagaacaaaaatacgttgggaaaaggcctccaacataatttgcatatatagggttaatacttataaaccttatgttctatgggaaaggccctgtggggaagggccctgtggggaccaggaaccacagtgacactgtcatgctttgtatcctaggaaaagcctctccactctctgggccttggaatcctcattgggggaatggggcggttagattacagaatttctaagctccttcattctacagtactaaagcagaaatttctaggcgcggaaataaggaaa

SEQ ID NO: 9513 - DNA, 1924 bp, artificial
  synthetic oligonucleotide
ctgtctggctttcccacttccaactggtgttggctaggatgccctctcaaatgagatcctttcacacaaatcctaggcacaggatctcttcaaagggcagtcaatctaggacaacatgtcaccatcaccatgaaagcataacttcttcctagattagaagcgaggtcttcctcccctgagtctctggggcacatcatctgggctctggaagattcaggacagactccttctttaaaatttttggaagggctgggtatggtggctcatgcctataatcccagcactttgggaggctgaggagggaggatggcttgagctaaggagttcaagaccagctggggcaacataatgagactccatctctacaaaaaaaaaaaatattaaaagttaaccaagtgtggtggcacatgcctgtggtctcagctacttggggtctgaggtgggaggatcatttttgccgggaggtcaaggctgcagtgagccatgatcagaccactgcactccagtctgggcaacacagagagaccctgtaaaaaaaaatgcttggaaggatggcaggatggaacctggtaaaaaagagcttatgaggagctatgaggcctggaggccaggggtaactaaaaataaatgtcttattaaatctggatggaccaagcctcagagtgcctttagtgcacgctgtcccatcttaagagagtctttctgcagaaatcatcattctggtgcctcacactaattggtcaagggtgggaacctgcctcaagaggttgtatttctgcaggcaccatgagtgaggagcatataagggcctagttaagaagaagagactaggcaaggatgaggaataggatgggaatccaagaccaacaggatggcactagaggtggcaggtgctgggggaaaccagtgccaagcttccacatagaccctggaaatggcagagcctctgctgggggttctgcgtggatcctgggatctggactctaagctccatggccctgggagcctcagtgaaggtcttggggaccatggtgggctctgagagcatggacaatgttagcaggatgctttgacaataagcagctcagtgaccatcaccatggctcttcccccagtttctagtctgctagtcccagggacttataagcctccagagaaggaaaggaacctcccagaaatgactgaccctggcaagtggggcctctgaaccaagcacaataaagccacaaaaaatgtcttgcctttaagagttatgaaccagacgtttgtatgaatttatcccttggtgtcactggtgggattgacttccaaggataggttgggaaagaccttgtgctgttttatcttaggacatgtgccttgggagccctgagctatcatgcagggagtcctgctaccctatgaagcctccatcctggagacaccacatgaaaagaccacacagaaatatagagaggggtggggggattgggaagatgttggtgaaaggacacaaaatttcatttagaaaggaggagtaagttcaagagatctgttgtgtatcatggtgacaacagttaataacaatatattgtatacttgaaaattgctaaaagagtagattttaagtgttttcactatgaaaaaataagtatgtgaggtaatgcgtatgttaagtagctttctttagccatttcacaatgtatacatgtatgaaagcattatattgtataacataaatataattttaacttgccctcatatgtttgtcacagcactattcacaatagcaaagatgtggaattaatttaagtgtccatcagtgaatgtttggattaaaaaaatgaggcatatgtcacaatagaatactacttagccataaaaaaaagaataaaatcatgtcttttgcagcaacacagatggaactggaggccattatcttaag

SEQ ID NO: 9514 - DNA, 1261 bp, artificial
  synthetic oligonucleotide
aatgtgaatgctgaatattgatctaacctaaattagaatacaagtattttgagagaaagtgagacacggaacaatgagtacaggggagggtggtgaaagagaactaaatacttatatttcatcagaggaagtcaataggtattaaaagataaggcccataaccgaaaaatcctgaagtagcagtataagcatgttatttaaagaggtaaatacctgaagagatagccaaaggaaaaggaaaggggatggatttgccagagacttctgtgtgctcataaaaagcctcgtagaaggatttcactgtttaagttacatgcatgtgtcgatgaccaggtacatagaaactagtattttgaaaggaaggtgcactacctttcttttggttgttgtaaagatatcattttatttagaactgcttcacttatataacaatacaatctctcacttataacccaaagccaatgctaaaagctacatttttttcctcactgatgaacaaataaaaataaatttaaaaggcaacattttgcacaaatacatgtagataaaactaaagggcctccaatagaaatgaagactccaagctccatagcctggaggctgataaaaggccaccataacgttagcaagcgtttgcctgatagttataaaggtaatttatacccagaacatttccacgcatgtgagagaatgaccctccattttactacatgttgtattaatgtcaatcaatatatgtttgagggctttatacattatggataataatgttggtgctttgcaaaccattcctcttgggggagctacacaaaattctgcaggagagaagagagcaaagcaaccaagccctggatggccaagctctctttgggttcagcagatgttaatcagctcagctatgcaaatgagactagaagcaggccaactcccagactgaaaacagaaaatgccctgagagtaggtgaggccatttgaaatgagaaagtggtatctggatgtgttcaggaaggaggttggctggacaggggacttactcctggcccacgatgctgtgccaaggaaagacagccatgtgggggactttagccaagtcacttagttacttgaacttctcggtggttgctttgtaaaactgggcacatcaatcacctatacagatgctcctcaagttacagtggggttacatcctgataaacccatcgttaaaaatattgtaagttgaaaatgtatttaatctacctaacccaccaaacatcatagc

SEQ ID NO: 9515 - DNA, 2128 bp, artificial
  synthetic oligonucleotide
ggactgtctcagatccctttaagaactctcccctcggaaaaatgcatctacccagaattttgcccactctttcaggggtttgcagtccctacttcaagcccttgcagggctccgcctccccaccccagtcccggtgcggctgagttggacccggcggccgcaggataaaatccagagaggagtccgtgtgacggcgcagcaggattaagaaatctcccagaccaggatgggcacagaaatggttaagggggtggagggttttgtttttcacctctgaggactctgttatgggtcattaagaacacaagaccgaacgagcattccatttgctgggcctgcctctagcgcacagctctgcttcccgacaagataagttctgtgcaggaaggaaatcctgggcccagggaggcagatgggaaatcaccccagataaggcggctgctccgagtgctggagtcacacagggcctttctgctgcaagaatggcactgccgagagtctgcgtttcttgccagctgaggaggaggaggctcttcggaggcgtctcctaacacattgctgttctaggcagctctgcaaggggaaccccccaacgggggtgcagcaccgtgcctccaagtgaaggagaggccctcgggttcccggagtctggagaggtggcctccagcggtgccccggccgcctccggctaggcccgcacacagtttacccccacccaggcctcctggcacccccgccccgcatccaccacccaggtggtacctgtgcccgcgcaggtgaggaaaaaggcctgtggaaaacatcattactgataaataacagttcctttcaggtttaatgacacgttgcatccatcctaaatctctcaaaaaaaaaaaaaaagaagaagaaaagaaaaaaaagaaagaaaaagaaaaaagccctctcgagggactgcgcctcgcgcctgtaaataggaacgacaggccggggcgcgcgccgaggcgggcgcacggcttggagcgggcgtataaattaaccgggggccgcagagtgaatacattgcacgcggtatttattatgcggccggacctccgaggggttctccggctcccggacgtggcaaatcttgtccggagcgccgctggccgcgctgccaagggctaggacgagaggacccgtggcggggggcggggggcttctcctccagtcctcgggagccccggggcagcccgcttacagcggcggcagcggggagggtttaggcgaggagagacgcggccccgggcgccgctcgggctaggggccgggcggggagggcggggcggtgggagcgggcggcgcgcccggccccttagcattccgccggcgcgcccgccatcgccgcgtgcgcccccgcgccccgctgtaattaccccgattaccaaatgaatctcgcgcttttgtgctcgccgggcggtgggtgcggggaggcagttctaatagttgtcattagggccgggggaggcggggcgccgggggctgagggtgggagcgcgggggtgggggaggcccgccattccctcgctggctcgcttgttcgctggcggtcccaggcggcgcgcaggccgctgctggctgctgagtaatgattttttttctaattggaggcgaacagcggccctaatggatggagccgctctcggcgcgttcgctgcgcccgcccttcgatcaatacggctcgctgagaccgccgggccgcgctccccggccctttgtggtcagagatgcctcgggggccccaatccccgccaccaccaccggccccccatgctgcctcagcctcgcccggggagttcccagccccgccactccgagacaccacccctcctccggcctacccccaccccggacactccaaccccaggctccttcccgcacccccgcgcccgagttcccctctcggaacactcttactccagctcccccaacactgcccccgcgtgtccccgccgtcccgagccctccatcccttcttgtcctcacactatgcccagtagcctggtccccgtggcctctcagacagggtgggttagcagggaggtgtacgggagggcagacccgggattgccaccctcaccccttttccgtgaccgcgtttctgccaagc

SEQ ID NO: 9516 - DNA, 631 bp, artificial
  synthetic oligonucleotide
attcgttaatgcagaaacatgccctttaaccatctcgttttattacacaaaccccccgggacctgagcagcccaagatttgcaaaagatgatggagaaattggctgagatattaagcccctttccaggtgcaattaaaagtgggaccaagacactcctgttctcacagatatatagtaattttttttttcattctgaattcgcattgtaaggattccaagtgcctggttgcccatcagatttctgacattcactggagatggggctgtgtttttattctcatctctacctctccatttctgaattgacaaccctgcaagttttgctgtgtagtctaatatttccacagctgcccaagcatggggcctatgaaataagcctgagtggcaaagattcccatgaacaatctgaacattctccttgcttgaagccttcaattccttaacacagactctctctgaagggaccaactgtattcagaatccctggagcaacacccagctagcctgaggagggacagcccaggccgggcttagagcaggtgaggaggtgctggcatgccacagtgggctccccactttcaggaggatctagaccagtgtacaaggaaggtcactggaggaggaagcaga

SEQ ID NO: 9517 - DNA, 2604 bp, artificial
  synthetic oligonucleotide
cgtcgcccgcggtcacaggggcaattacactcctcgctgcagacggttaccagctcgcccgcgcatccctctctcggctcccctctcctcccctctcctctcctcccctcccctcctccgcggaactgctggctccatattagcgagggtgccctggcagcgcgaccgaggccaactacccctggggaccctcccgaggctccccgcaccctgcacaccctcaagatcgccaaggcgagcccaccgcaccccacagcgcgtcccaagggcaccacagccgaggaagcgacttttgcggtagcgaaagggtggcagtacccagctccacgcgctgcaagactctagcagccgcgcttcaccccaaaactctgcccctagccagcacagctcccctagcgccccaaatcccaggtgtgcctgtttccctggagtcccgccggcgtgctttgctattcgcagctcgacgcctagacctcctgactgcaacctccgaggcctttgcgctcccaggcgtcctttgctgcaagcaaacaggcccccaaccgccccctatggtttgtactcttctggaaggtgtctttggcgctgtgaatgcaaactcaggctttggattaagggcttcattttcaactaactgtgtgatttgaggccagtttcttaacctcagtttctttatctacaaaatgggagggatattcgtataagtgtggctacgaggtttaaagaagatatagttatatgtcaaatgcttagcacaaagtcctggtggttagcattattattaccatatggccagaactgtgaggacattaaaagtgaagtaggctttttcccaccaggggtaagcctcgcggagtcctaggacacatcccacaaaccgaggtgaacctaagccaccggctacgtctgaagggaggacagacgagacgaggggcagccaactgagcgaatcactctgccttccgcctttgcaaatgaatagggctctgtctacagcttccgccattcctacgccagatctgcaacgcctaaggcttaaacttggcgcggcggtaaatttagcccgaaggcagcggctcctaaggggcggggatgtctccttggaagaaggaaagggaacagggtaagaaaatggagttgcctctaggaagaagaatcaggcagaggaaacattcagggccgctggcggaccactgacaaaaagaaatcggacgcaaaagaaacctccccagaagaaactgggccaccgtgggagccgtgcgagacagacttcccatctgggaagggctgcctacgggtaattgggtttgctcgagttgcctctataattaataagtgatttgacttggagattggaaatagtcatgaaaggaagccgcgggcgtaggggtgtgaggcccaggagcctccatccgaaatccaaagaccgcggaggaggacggtttaaggaacaggacgaatgtgataatattggcatctaaccttctagtgtttgagtaattcgttgcttagctactttggataggccattattttgcaaactggaaacatttgcaagtggtgatattttgctcttgcctgacgcaggggctgcaaacctacgccggctctgctgaactcttcgaaatatatatgcataaattgttcctaatgagaccatctgttttttatggcccctctggaagcaggaggaacccgaagcctgctccgtcttgcagaaatctgtggccaggcaggcctgggaaataaataggggagattagaacggtgtgcgtgatttaacaatacgcagaacggcaagttcggtggtcgagatgtgtgcctcgattcccaggggtgcgggtcatttagggtgactccagacatgggggttcctcctaggaggcccagggactttgcggagttccacggcacacacgaacctcgtttttccatatctggaacatcgccagagccacaacgcgaaaccacgagcctgtagctgctctggggacccaaaacaagcacccaggttgtaggtggtccccgacgtcgcccactatctagggcctccttctacggtggtgaagggagctgaacctgggccacagaggcagagaacgagcatcactccaccccatacccgggtcagagcacagagctcattccgggcctatcccaaagactgagctgctccgcgagcgtctggcaggcccagcgccccggcctgagaccgcactgagggtggcagggcaaacacttttcacattaccgcgtggctgttaattggggcagtgcaaaagacgccgcgactacccctttgcggcggcgggggaggggggagcgggtcaggagtgggcagtgggggctgcttataatagaaggactgccctggggagcctcagatatcggtaacccccatgattaattcataactctccactgcgcctggcaccgtctcgggtctttaatcggttctgaatgtcagcgaggcttccccgacagcctgagcactgctttttcaatgtgttgaaagtcgctgcgcgcacaccaggagacaaagttgccatctgctccggggaccaaggcaactgggcgctgggaggggccttcctcccgcggctc

SEQ ID NO: 9518 - DNA, 2878 bp, artificial
  synthetic oligonucleotide
gggagaggcggggtggggtgacggctcataaatcatccagccccaccctcgggcctcagtgcagaggcgccctagccccacgaggaagaggaggttcacccagccactcctggccgacctctgagctctccgggagccagcgccccaccctaggctcaggccgcgctaggaccagctcccggcccagatcgtaaaccacccgccggaatcggcggaaagccgcccttggacacagcgcgcatccgcccaaggggaagtttatttatagcttgtaaacgtaaaggaaaccagaccgcgctacctcgccgcgctccggctgcttcgctccccacctgcccaccaggagggcgcgacgggtggagggaggtggggtttggttctgtgccccccctcccccgctcccgctccgctgccaggggagaacagggtcctaagaggctggcaagccttacattcctctcgggacgcctatccagtgccatgaaagccggagggggcggaggacagggcccgggcaccggagtggttagggtgggggtggccgagctggcccacttggcacggaagggcaggcaggccaggcgacgcggcgcgagattccacagctcccgctccggaccgggggaaatcctggagtgccagagagcccggggagggggcgctccgggagcctctccttgaaaggcgggatgctttccccgttcctcccgcgcacgtgtcctcagcagagcaggcaagcgctgcgcgcctggggctgcgatcctcgggtgacagcgactgagagcgcgccctctccacccccacccccgccgtcgccgcctctcctggggagctccagtctccagggtgcgctcggggcaggccccaagagccagagaaacggaaaagtgccggggaggcgattaggaagagaagacattaaaaagcccagccctgaaagacaggcagccgagctgaaaaagacgcctgcgaacccccaccccgccgcccctcgcctactgcgcccagacggcccctccttgtcccggctgagcgcacccacccccggcctcggccggggcgaattcgtgtgtgtgtgtgtgtgtgtgtgtgtgtgtgtgtgtgtgtgcgcgcgcgcgcgcgcgctcgagtgccgggagggcagttgcgaaacgggctcttggctgcagcgcggcataatggaggtggctggaacaatgcgcgctttgtgcgcgcggggagttgttttccacccgcctcgccccccttgctcgggccgtatggcactttaatctccgccacgactcggcacaaatgcacttgtgtcctgcgggtcactgggggccgtgcggctggagccgcccccaccccgacccccgcggaacccaccgccggctgccccatcttccttcctgagcaccccccaccaccacctcaattcccggcgtgggccggtgagctggcgtggaagcttccgggcccgccggccacttttattttccgtgaagacggcccctcccccgctccacgagcgcgcgcgcgcacacacacacacacacacacacacacgccgcccgcaggccccacactcaccgccctctctcgcctagcctctcctcggcccgcctccgcccccgcccccgcccccgccccgcgctccggactcctgcgaacaatagtaaatgtcaacagattccgcgcggcgagtgtctgactcggccgagataagggtgcgcggttggccccgcgctcctcgtcgccgcggggggagcccaccctgaccccggctggaaggaaccggctgtgactaaacccgtgccgggagaggggggcgggagggcagggcaccagtcccagctcggtggggcagcctcgccaggagaccaggccctgccccgcccccaccccacttaacccgttgccgatgggggaacctatgggcaccgtaaaagccgcggggtcgacgtggcggtcgggcctgcttttggcccacagctgcaatctccagaggatatcggcaaaacgctgatccacgtgaggactcgcagttttcgacctactgggagccagcacctgaagcaaaggattcgagtcctgatgtccggagactcattaaaatattttcctaagcgcgcacacactcgcaggtcctcctccttggtcgtcggtaacccaccacccaaccgaattaaaattcgcaaattgattcccacgcgttggtattaatgggttgttcctcttaaattgttgccaactttgctaatggattattatttaaatgatttctttttcataaagtacgtgttgttttatagatgcgtatttacttaaagaaatcaactgcatgtattaacatattaaagagagaataaagcatcggggccggtgtaatgtactgttcagccttactttgggtgctctcgaagataggaaaatcttatttgtttaataataagtcactcatgaatatgcaaatggcatcggtgcagtacctcacttctgtcactattaatgagttgcaaattaatgtgacaacaaaaggaaaatctatttagtggaggaactcaggttcctacctggggagatcacaagcaagcctggaacttgagtctccaggcaggagaggactggggatggacacgtacctcctcacgtagtgttttcctggagcctccactattgtttggtttcagggacctgctttgtcaggaaccccttaaaattcctgctccagaccagaggaagaaaggctgctccagggtaattagggccaagtgtgattaatggaaatcaacccacagtttgaagtaaagcagttggccaagcagattttggggggtctcctcccccgagcttaaagattccccaaagcctttttgacctctgttgctttggacag

SEQ ID NO: 9519 - DNA, 1781 bp, artificial
  synthetic oligonucleotide
ctggcggggtaccaggaactcaaagaaagcctgttgctgtgggcatctagttgatgaagtcagagtaggtggtgctgtgggcaggcttcaggacggcacctttgcgtgctgcagttgaaggcaaatgtgctcttgaaaacgggaaggcttggaagaaaaggttaagggatgtgggtaatcaaaagccaatctgtcctcccttccccccaaaatacaccccccttagggtactgaacctgcacacttgcatttccaagctggaaacagtgtcgagtgcacagaacacagcacccgcctgtctctaacttgtctgaataacagggccatttcagaggggaacaacggccttcagagcctctgcaatttccagaaagctttcagttaataacacattctttccaacaagcttacttagggctgaaagttattttcacaaatcttaaaaactcagccataaacagctgaggacccagttcaacggatcctggccaaaccccaccaacacggtgacactcacggccccgtgggccttctcccgccacctctgcctcaccacaagttccctaaaccacaacatacaaaccatcctgcaccccaccccaatcctgggaagtcataaagatgtgtgttggggatggagggcgggtgtgccgtggagctttctctcatctggggatgcgctggccagaaactggccgccacctctgcagctcgtccatgggcctgcatagtgcgcgctttgtgtaagtgctgaggaggcgcagcgctgctcgcgcgccaacagctgtcacattatttgcactcgctgtaaacagccttcacattccccccttaccacatagttaaagccagactaacaatccacagttagagatcaaaccaacaacagcagcattgtgtctgcctttgctgccttcacaccaagcccagcagctggcaggtttctccggaacaagggaccccttctccccctacccctccgggatccagccaaggctagccaaggaagcatgcgtttgtcagcgctgtttgttaaagcaaaagagcaccgccatttcgcagagatttccgtgtggctcatcagccctctccgagagtttactccttctggaagctcgaggaagcatcacgagaataaaggttgtggagactcgcagggttggtttccatgctcagcaaagtggggtctggccgggctggggccggggccgggacagggaggtctgcccctctccatgccatgtcacagaggccagacaggtctgtgctttctgcagccctcagcggaatgcctcctgtctttcggaaattgcccaactcactaaatacttactggccgccccactgatcaaaatgtctcctttatgatttttggttaagttgaacatttccataatcgtcattattagtgcaaattacacgcctaatcggtccttaaatagattttaattaaataagcatacaaggctcattttatgacttaagaaaggcattacttttcgttataaactttccaccaggatatagaataacgatagcagacaaatacttattctttgaaaatcaccaataaccgatgggcagagtatcatgaaacataccctgttttaccctctggaatcaaagctgagaccagacatatcacagctgtacaactttcctcctgggatgggagagaggatttcttcctccaaagcactatgtctgtcttccttgtggccagtagaaataaacccccggtgctgctttccctacccatctgatgagatttctctagttga

SEQ ID NO: 9520 - DNA, 4708 bp, artificial
  synthetic oligonucleotide
caaaacccgcgcgctcccctaaacaccccaaggcaattggtgtgcgtggcggtgtatacccgcacactgaaggccagcctcggattaaacctggatggcatattaatcatcgccttccccccccactccgctctacgcgctgaaaccctgcccaaaataaacacgaaaaccaacactgcaaaacccacaccagataacaggtcgagagaggagtgggcagggtcaaggaacgagcgtattccctaagtgtccacgtacaggaatctttgaggctgacaattaaaatgccttccacgcaagcaattctgttggcaaaaccgaacccaacacttcgtaaggattgatttcggcccgcggtgtccgtttccagtgccacaggaagtgtcagatggccagaaatacccaagtctgtctgcactcaccacccaccaccttctggggtgggccatttcctcctagtctttactcccaggccattttaaggatctttctccaaaagactacccctagaaccaaataccacactacccctcctctagcgtcttctcaaaacgaaaaaagggggggaaaacacagctaaaaccccgagctgtctagtctagacgcagcgaggctgtgcgaatacctatttgaagcgcgttggtttctttttaaggtttgtttctaaatacacataaccctcctccttccttcttcgctcttccattccccccacccccaccctccagacgccggcggcgcgcgccctggcgcgcgggcactcacagcctctagctggagatcgcggactttctggaaaagattcattaacagcaaattacgcctcgcccggccacggcctacacgctgccagactcgtccgtctccgggaccccgggaagggcccactcgagcgtgcgagcggcgggaagcccgccgggaccacgcgtgacttcggccgccctactccacacacggtgccccaaggctctctccgtaaacagcaggcgctcgtcaccgccgccgcgagcccccgagttggcggaggctctgcggcgcagccgcccgccggctccgagcgcgggccccgcggcgcctcgccctccccgccttggccgaggatcttgccccggtgcgcaagttcctcttcgcctacagcctccttgccacacgccctccgagtgggaccaacttcctccggccgcagactttcacacgcccatcagggctacccaccagactccccattgcccagcggagggcccaggtctcgcccgcccccgccctccctccacgacgctgcccccgcacaagcacattctacacccacccctgggggctcataacttaaaacctacgctgaacatcggggagggagaggagggggaaagcgggagggggatcgcagattataatcttaaaagaacatttacaaaacaaagcgtctgacctggctggcgggcgggccaagtcggaaccccttgctctgctcgatttcttagtagtttttttttttaatccacgtgattcgtgctttggggcaagccaagaaaaaacgggactcccctcccgagttgcgcggcagcggcggcaggtcgagctcggctcggcccgaggcactcgccacacaccctcgcgcacgcacacgccgacgttccacttggaggaacgaccggcccccggagaggcgagacgaggcggcggtggcggcggctgggggtttttacagttctttcccgagtcgaaaaagaaagcagacggcaacccgctgccctccccttcctgctcgcgagctaacgccgaacccagcttcccagcttccagcccacctcccccccctccgcccgactcgcggcgctcagcggcgaccgcgctcccgcgcacagacacacacaggctgcaaacttccactctgcgaactccctgctctcctcctggcccaccgggaggcgccaggcccccagccgcgccccctccctccctggtgcccacgcggggccgcttaggttggctgcattttaaataacatagctatgaaataaaaacgaaagcgagccaagcagccaaagggaagcgcgaggcaaaagcttcgcggggtacgctgcgggagggggccccgggagagggggccgactgcagccctcagcgcgcccgcccgcccacccgtccgcggtctcccgggggaaaggtgttccgggcactgacctgaaatccccggtgggggagtaggcagggagcctgcgatccggctctttgaagttttcccccaagcggactcgaggcggcgagaaggagcggggggcggttgggtgggtggagagagatatgaggggtggggggggttggcgacgttaacgagcggagaaggagccgggccggagaagcgcggcgagcagcaaagtttgcggtccccggctgcccgcagcccgctcgcggcgccgcgctcactcgactccctcgccgtctgctggcagccggctgccctcggggtcggccccgccgaggggtgggctctgggccgggtgggggcggggcggggcgggctcggggcctccgggcaggtggcgacagccccgtgcgatcctccgggctcccgcagctggactgggcttggccgagctcagcagctcccgcgctgccgccgccgcccgcgctcgggcaggagccccagcgccatgttgacggttcgccgcgagcgcccgctcgggctgggtgtgtgtgagtgtgtgtgagtgttggccaagtcgtccctgcgcggcgacagcgcggcttgggctctccgcccggcggctcgcgggctccccctccgccgccgccgcccgcctagctcccgctctcggtcgcggtctgggctcctgcgcgtctcccccgcagccgccgagctcggcccgcgttcagcgaggagcgcagctctgcctcaccttgccgctgggagcccaggctccgtctgccgccgcacgccgcgatcccaacgcgtcccccctccctggttccctcctcttcctcctccccctccctccgcccgtcctccctcccgcccgccctacctccctccctcccaacagccgcctcccctccccccgcaggcgcagcgctcgggcgacagccgcccgcccgccgccgcctccagctctcgcaagtttgagctccgccagtctccgctcaccctccgctgcggcgcctccgcggcggggtttcgggaggggtgattccccaggaaaggtttgcccgagtttccccggccgtcatcgatgcacggcccggcacgttttggcctctctggatccgaaccccggaccacttgggtggcgccccccctcctcgtcccccggcctcccctccccagctcgggccgagttggctgcgcacgcccgacccgggcgcacgtcctgggcgagccggagaccgacttgggcggcggcggcggcgagggctgccggcagagccagagccgaagggatgggggcggcgggggcggctctcccagccgcgcgccgagactcccctcgctacccagaaggccagtggaggaccgcaattaccataaagcgcctcgcactccgctcagccaaagctgtcaaaccccagcggcagcagccgctgccgccgcctcttgccaccagcgctgcgctctcccggcctcgtcccctccgagacccagcggagcgtggcctgtgtgctcccgtgctcacccccaccccagtttgccccttcctcccagaggagccctttcccatttcggtgttaaaagctacctgaaaacaccaccccaggcaacggtggccgttccgcctgaactccgcgcccgagttccccggacgtttcaattgtgtgggaattgtttggaggtgggggaaggggggagcagcccgtggaggcaccgggaggcgtgtggggggcggtcggcgagcggagatccgcctgtatttctcccggttctcgagcattttcacggtctgtacctctgatggttggaggggctgcccaggcccctcgccccggcgttgggagattatctcccgcgttttattttccttgacagggagcaacttttggcttacaccgttcgccccataaatttccactcggtaacgtcgtgctgatcggtgcttggcggcggcgtacagcctgcgcccgcagcagttcaattcaattgacacgtattgagcttctccagcgcacccggcgcggctctgggcgcggggggagggcgggggcaggcgggagggagggggaagcggagaagcgaggttccggcctccccggagcgcaaagcctcaagggcgagccgagaagccctagttggtgaagctggcgggaaggggtaggagtgggggagggggtattccggactaaccgcgcccagactgcgggcccggacttcgcggccaatggtgaccccattcggctgcccactagggtctttttatactgggaagggggtggggtgtctctttctgcctaaggacaagatggtgcaggctccatgaaacataaatctgaaatggaggtggcttgtaaatccacacggaaagtttttaaaatatcctggagtgtccccatgccaaaaataatcaaaagcatctcaagttgattactaagtcaaggtcaaggccaaaatcagctctagctagcagatattttcccttttaaaaattagactcactactgactgtgggactggtattaggtgcgattttattcattctgttttagttctcagcacata

SEQ ID NO: 9521 - DNA, 8066 bp, artificial
  synthetic oligonucleotide
cgcatattttacccggctgggggcagtgagtgggaaccgccgggagagggggcggggaaccaccaactactcgccttcggacccagtgtgccggcctccggccccagccattttgtatccagcttccctcctccactcccaccgggtccctgcgaagacgcaccaccccgaaccccttcgcggtaccactcccgaactggaggggtagagaaggctctgccagcccctcgcctgcagcaggaaggtgggtacggaccagcagaagggaaagcggtgctgatctgtctctaaatacctctgccctcccgcccccaacaaagtcggtcacagaggtgagtggcgcgggatggttgcctcgagaaggtcgcagccaggagcaaagctttggggctcacaacggactgggcattccaaacggtgtaatcttcggcacatttcacccgctcccattccaccttccgaaccactctgctctcggtgctcatcctcctctccatacctgcgttcccagcgcgttagcagccgcgcagcccccggccctgagtgcggggggtggggtgggggggctcagggtggtttgtgtggtgcggcctgacagaaccttctgtgtgcggcggagggaggaggctaatgcataatgcacagcgcctggaagcccggccattagcggcctgtcggtgacacagacaaacgactgagagggaggagatccagctcgctctggagtttaaatagaccagcgtggaggggaaacgccatgatttaaaagtgtgtgtttgcagacactcgcatatattttaatgatttccagcaggctatgtgtcctagccttgcatccccccctccccaaaaggaggatgtgtctagaggagggaggatgaaggcagagtgagaggcctcaacccagacccaccagcagcttttgagagatgaaggaggggagaagttcagaaagcgaggcctggggaagccacacgacccaaggccaagcccagattttgttcttaaaataataatttaaaaaaagagccacccagccttccaccctggactacaccctgtgttgtaccagaaaggcctgggggaaagaataaattctgccacccttgcttcccccgggagcccacatttttgaatcttccttttccactgacactccagagacctccttcctcccggtttaacacactagtgttttttagcaattaaggcgagaagggggtggggataaagataagccaatttttttttccgccatgcaagtgtgagagataagataacgctaagctggggcaaagcggctgcttacaacctccccttagcgattttgatcggtcacttcttatctcgcaaaaatgctcttttcgaaaactggatcaaaaaagaaaaagagaaaaagaaaagaaagaaagattttcatttggaagtgacatttaaaacccacctcccctccactgacaacccaccccccattggcggggctccccaggaaaagtcgcacctcgactgcaggatttcaggctttctcgcggggggcaggattactagtgcaattaggctgaataaaaccagggatgcgtgatgaggatttatcctgtatccaacccaagctcgcggctgggttttccttctcttagttactggtcgatgtttgtgtttcgccatcgcactcagtgccttcaaactaaacaggtagttatacttgggagggtcatataactatgtcaacatgaagtggttgttaatgcgaaataagaagaaactcttctgatatttataggcccctataaagggagagaaaggaaatcacactccctagaacccgaaagctcccagccgaaccggaccctcggggagttttagaaatccttctttccgcacaggaatttcgcgaaggggtttccggaagactttgtcgaggaaggttttggtatcagactccacgacctcagagcgccctgcaaattccccccggcccagtggctagccccagaatgcaaacctcaaggcgggcgccccagaccaagctgacctagcctctgcccacccccagctcacaaccccgaggctcccaccccctgcccccgaccgggtcggcaccgtggcgtccggcacatgccaagtctaccgtctccaagccaggctgcaagatccaaaggttggggcctgccgcggacggattgtccctggggagctgaaaccgcccagcggggaaacccctcctctcgcccttccccgaaaagcttggccgcggtctaagctccgagcaagcgggtatccgctgacagccgggcctcacgtaaggcccacacgcgtcccattagtcagcccgagttcccctcgggcgagccgcctggcgcggccccaaggccgggctcaggcggggagagggtgcggggccgcagcgagctgcgggcggaggtgcgggctccgcggagcccggccaggctcggttccgcgttcctgggcccgcgggtaagctgagtcggcggggcaggccgctccctggctggcgccggggcgccaagctgcgcttcacgtgcccgccatatcagcagcagcggcggcggcggcgaggagggggtgctgggaggcgcgcggccgttcccgcggggtctccggaccccgcctccccgcccctccccgtgggggctgggccgagaccaccctgcggcccccatcccagcgcaagccgaaagcggcgctgccagacgcagagaggctcctggggcgccgttccgagagccgcgcggcggcagcagccaggggagggtgctcctcgcggccgccccgccgccgccgccgcagtcacggggaccggaagccctcgcgccgccccgagcggcctccgctggccccagggctgttccagacgagggctggccgcgcgtcacccctgatccctcctcgccccaggcgaccacccgggccctgcggtatcccggtgtaagccgagaggacccttcctgcggtccgatgagatgtccctgtccctctgctaccaccataagcacgcccccccgcaccgctcgcagctccgcagctgggaccggaggggcgcggagccgccactccggccgggcaggaacacctgctcccaggccctgcagctgggcgcgtgctgctgtgagaggctgcctactgttgtgtgcagagatcgcggaggagaaaatagggctccgaagctcagggccaggagcagccaagcctcggccacccccatctcccacccactgcaggcgacagagcgcgaagccagagggcctgctgggggcccgggtctcctttcgaaggtcgaagggccgccacccctgggatccggcttctggcctgaagaggtcgttcataaaacagatggggcaaaacctgttttgggagccttcccagtgtccgcccccgctctccaaaccagacacactcatctccccctcagccctactctagcctccggcgggggacgggagtaggtcatggcggcaccggtactccacccgcccccctccacgtagggacgtagggtcggctgcggggctcggactttgccactccacctagggaagggccaatggacgctccccgtctcctccgtgtccggaggagatccggcggcggagctgacctgcaaggcttgccctgcctcacccaccccccacctccgtcccaccctccccgactctcctggcccagggcccggcccgggaaggcgttgttttgccagcgggagccgagcgagtgcacagagaaaagcctccctactctaatgagagtgcacacagcgctgcagcgaggaggatgattacccggcgggcggggggcgcgggctcgggccgcgggcggcgtgtgcggcggccccgcgggcccggagtccccgcctgtctggctgctaatcgcacgctttctgctgttacggaggcaggcgggagccggcggccgagcccagcgccgacgactcggcgggtgacacggaaacatggcgcagcgcccctcccccgcccgcgctcccgcctcccgccctccccgcgctcccgcctcccgcctcgcacttcctcccgcccgcgcggcttttgcagttttaatgctctgctttcggcctggcaccattacgctagcagccgcttctccgcggccccgcgcgtctctttcccctttgttttcggggtctatagaaaacgtttgcttttgtcccgagctctcgttaaaccaaacttgtggtggcaacggaaggcggtgcaggcggggaggggtccggggattttggcagtagccggccagagcgtggtggaaacttctctcgctgggttctccgctccctcccactccccctccccaacacagagccgccggcctcccgacgcttctcccttcgcccccgagaggccccagtgctccaggaaggtctgggccacagagactgtgaccaggggtgaagaactcagagtgcgtgtctgtgagccccgaggttttggcactcgatgaccttgctccctgcagccccgacttacctctttccctttggtcattcggggctttgtatcagtcggtgaagaaggggagggaagagaaagtgtttctttcgtgcgtgtggtttttattttaaggatttgttggaatctgtcacccccaactgcacagccccctcccgtataggatctagggcgaaagcggggaaacgtcggatttagggggaaagggtcgggtcagaaacctagccctggaggctggatcgtactctcctggcgggctcagccacacttggtcggcacgcggggcggggcgacccagcagagtgggggacgcaagggccaggtccctcggtccaggagacgccaaacgttccaaccttggagcgagagagcaggaacccccgcccccacccaagcgcgcgcgctccctagctcgacgcgcaagccgtggctctccgcgccagagctgctcaggcggcaattttttaagcctgcaattaagcgaggcgtcgccgtgtcctctgctagtgtcggtcctgtcagtcgcacatggccttggtgctccggtccgaggccccgcgattagtcacaggctcgcttcgctccttccctaatccgcctctgcaggcagcctggggacgcggccgacttggcggcgctggcagggagccactgcccgcggggcgggcctcctgaccagtgccagccccgctgcgcccgagccggcgcgggccctggggtgcgggtttggcgcccctcccctctcacagccccctggctggggtggcggcgcccctcctcctcccgcccctctcccgggcctgcgagatctatttgtgtggtgtcatttgcataaaaataggacaagtgtttctgtgcgttcatacgcgggaggcgaaatccttattgatgtgtctgtgtggagccttcgattgtcggagcggtttgatttagggtgtttgtgttgccttctacaagaaaggagagaaagtccttctcaactccttcggcggcctgggcccccagaagcatgtccctctgcgcggccggaatggtccaccacttgggccccaagcgcgccggatccacagcgagcaggttgagggccaggcgggaggcccattatgactcataaaatcgggcggcctaatcgccagctgccaacccatttacatgtggagcttcccaatgctcccttcgcccgggcccggcttcctgagggtttgccccgacacagctagagccgccaagtgggagctaatctagtggcctctccttcccgtcggcagcgtggcttcccttccccggcgacccccgctctcttggcctactgcgctgctcgccagcaactcctcagcttggacaaatagctgggagggcgccggccgcgcggagccagtaaatcaatcattaactcccaagcgaggcctggaccaggggagggagcggcggccagagccgagtccgcgaggcgagcgcaaagcctccaccggggttaggagccacccacgcgccaacgaaccgggtgcgtgaaggcgggtcccgccatggcctcccgggcccctccagaagcctccgcccgccgggcctttcaagcccgcaccttgcctggccaggcaggtcgcgttacagcgctgcccctgggagagcttgaacattaacgagtcgcctcgggcctcagcggcctgctctccacaggagagcgtcccgcgcttgggcaagctcctcggatccggccgggctcctcctggctcaggcttgctaaaccaaactgatcgcaccctgtatcgaccaatctccctgcggcaccctcttccctcagcccacggtggagccggcacgcagggggttaaaagccccggttcgctctggctcctcggctgcgaggagaaaacgctgatcaaagtgcttaaggggaaggtaacacatgcacattcggtcccgggtcgaaggaggccgactggagacggctcccgagccacccgcctcgacccgcttcccacactcccgggaacgcggcggcggcggcggccctggcccgcacgattcgctcggcggagcgctgcgctgctgggctgggagggcggcggggaggaggagagacgagggggcgggaggcgaacccgggctgcgcgccaagaggcccggagccgcagattagtcaccgctcggctctgcgctcccgggtgcgcccgggaaccgggagggcaggcgtcggccccgctcagccgggctccccggtcctcggcgcgggtgcccccacccccacccccgcgcgctcctggcgcggctggctcgactctcggggacccgcgcagccgagatccacttgtcaggtcaagggcaggacagaaactctgcaagcggagtcttgcttgcgaacaggaaatttctccttgatgaggtgctgcccctcccccacgccgggcttcaaaacaaaactccagagcgggcggccaggtacccagcctcgctcgccatggccggcgacctccgctcctcggccccggccccgggcggcggagccaagccaacagagccggcggacggactcggcgccggccccgcggagggcgccaggctgccaccctccggggcccggacggggtcggcgggggtgcggagccccggagcccccgcgcctccccaggttctacagccaccgagcggttttgcggagctgcccgaggccgccgggtcagcggctccccggagggcgtggggggcggggaggccgcgcggcgccgccgactcggcgaatcccgctgcgggagcccgggagggctgcgagctcggcctggcaaagttcctgtggaaactccatgttttgaaactcctgcggcgtcgcagaaggagggggagaggggagcgcgggaagcgcgcgggggcggtctgcacccgcctctccccgccggggagtgggttccgcggccccccgggcctcatgggaaagctggagggcggggacggccgggtccccgggcccgttcttttgtgtgttctctctctcttccacactctaagagaaatttataaacccgtttcatttaatgaattcacccgggagaggaaggctgcctttttagggaccatgatgttcagggtaatttcgtatttgacacatgtaaatacttagtactctcaggtaaggtcaaattatttatcatcttaatttatatttcaataggcctacaatttagaggcgagaaatgcctccttatgaatcattatggtctattaggggaagtaatgtataaacagcactatttgggagggaatcacttatgttgacatttaaatagctcttcaatagttaaaaaaaagacatttgagtgtctttgattaaatatacaatttacaagaccatcagcatagccatcaggaatataaattcttcttggaatttttatttatttccaatttttgaaaccttccagggcatgcgtgtcattgaatccctatgggggaaaaaaatcttaacatttcaggcaaaatattctcctctcccctagcttcctgtcttatcaggaactcagggaacttctggaactctgagcacacttcaccagcagggaccacagtgggaagtttgtagatcctgta

SEQ ID NO: 9522 - DNA, 1800 bp, artificial
  synthetic oligonucleotide
cctccactttgttcttcagagttggcttccacgacttgcgcctgtttagccaggattcctcttgcctttgtgaccgccccccctccccgccaaatcccaatcctggaggtgaacggctcagtctctgttaactccttgcctgctggtgttttttctctgtagctactaatcacctccttttgatcactgccaagttctcaggttgaaggaaggagaaaggacctcttgaccactctggctggctttccacatgagcctgaaaatgtcgacaaatttgaaacatctgccgagctgctttggtctgattgctaaaatatgccgacctcaacccccctccccccgccccttttaatctgtttcatattcacaaattaagcatttagtctgggtaataaatcaaggcggtttacgaggctcacacgagacaaacaagcgagaagggcgcaacacaagcccctggaagaggactgcacggagctgccaggagtcgggagctcccagcgctcgaacgcggagagcagcctggcgcgtcctgacacgccgccagcacccacactttggcaggtcccagagccggcggggcgcaggcgaacagctccggactgggcccacacccctggaaccttccgcgcgaacccgcggcgcccggcccgccccagctctgggcaactcagcccctccgccccgctagggagtggccgctggcaaaggggacaacctcacccgacacacaccctgtggtgggcccattaagtctctcccagccaagccgagaaggctgaatccccctcccccacctctaccatccggcagggcttggccttaaagatcccaggcccacactcaccagaaaggcaaaagagtccccgttcaggtccacgtgtgacctccactaagcctggaggctaccccctccccgccccaaactctccgtgctgcctcctcccaggtttcggtcccagcagccacaaagctactttcagattcagataggggtgggggtctcctggagagcggatcaaggtttaagagcggctggggagggtagcaaaggcacaaacagggtccaggccccctctgcagaaaccccggcccaggcttttgcgaccacccaaactcagggggctccaatctgtgcgtttcccgccctcccctgtgcagcagcgagaagcggacccggattaggggtctgggaccattcgcaacccacgagcttgggagaccccggtggggagggtggctccggggtcacctcgaccgggcctctgttgcccggctatgctcaagttccctgtcgactggcgttctcgatgctatcgtgggacgcggcggcggagaggcggagggcgggaaatcgggaagcctgaacatgcagcccaccccggacctaaggggaagcgtaggaacaattccccaccctgcaacacagtacacgtcgcccttcctcttcccctagcacacattccgactgcgaaagccattactgccggcgcgcgagagactttttaaatatttacagcccgctctccgcacggtagcctgatccatctcgtgggcgcggaggcggggcgcggggctccgctcccgcggaggcgcggagccggggctggggagcccggtgcctccccccacggccctgaggtcctccctgcgcccccactctgtttaacccccaggtggggagaggaccccgagactgcacacagcgcgcccggggccctgccggggcctgagcgggcgggggacagtgtccgggaggagggagggccgagaggctgatttaaaggttctcaccgggaa

SEQ ID NO: 9523 - DNA, 1755 bp, artificial
  synthetic oligonucleotide
tccctcccgaggctgttggctttaaacacacttgctgcactcacccccaccacacactcagtcgttctcacccttcctttctccctgctgggcctcctccaaaccggattgcctagcctgaatgcagagtccaggcagagcaggaagcctgagagatcaagcagaggtggccgaggaaacagaagagagggcccttcatgggggaggaggcccatgtctgagaaagaaggcagccaggagacacagcctgcaggagagagggagtataaagggaaagccagcactaatccctcagcctgcctacgtggggcctgacaatttacaaaagccttttccccgaatattatctcatgtgccgcggcagcctcaccaccagcgctgtgagggaagtaggacagatagcatcacccccattggcaaaggagggaaatggggcccagcgggttgagagaggtctgtgctaaggtcacagcgcgaagagtggtggaagaggcccgaggcctggggtttcctgccccaaagttaactttcctgttccatcgttgtgtatgtgtttctgggtgagcatctgcatggaggggaaggactgccggacaggaatgcacagtccagttagggaagtccaggaaggaagaacacagccccacacctcttcctctgcccgggtctcacacaacagcccctgctctttccacaacagcctggagccggccccccaccagcctgcctggggggagctgttagtgcctggctgtgccttcagtagtgcggatttcagagatctcgtatcctctgctctgctccgctccgctcagctctcttctcagcctgtcatccccacccccagcctcggctgcaggatgccttgcgtccaactgtggtttccgggcaataaaacaactattaaagtctcaggcacggctggtgatttgcatcacatcctcttgtgcatggattcaatgtttaatacacaatattgaatacggatattaaaaatcaatagctggggacccctggggaggcggcacagtgcgatcctgcttcgggaacacaaccagctcttctaaaaagacaggaacggcaagttcagccaagctgagcccagcgccaggggaagtgaggagtagtggatgcatctcagcttcctgatatgcttaactgcgccattcccaggtcaagctaaagggaagccaaaggaatggtgtgcccctaggctctactagctttgagatgggagggtggggaggtacggtttgtttccaagcagggtaccagccaggtgcgcggagttgctttttttccttgttatttgcacttaggtttggttcgagtctgagtcttacatgcaggctctcaactcttcccaccatgatggctccttcctgggcctcatgacatccatcaccataggccccatggggagctcttggcataagctttcagagagatggaacaggaatcccaatggctccgaatatgctttgcacagtaaaagaaatgtgaatgcatgataccaggctctgagctgcaatcttctgaggcactctgagccttcagaacagaaatcctcaggccgtgtgacccgcctaaaggcctggtgatggctgagtggtgacagaggaaaggggacgagaaggagactgggacatcgaagcattcctgctccagagccagaatccagattgtccgttaaacagccaggagaagagcaagctcccaggatgcataattatcttttcaggcctgaagaggaac

SEQ ID NO: 9524 - DNA, 7450 bp, artificial
  synthetic oligonucleotide
gcgcctggtgtttacacactgtcctttcgacgtgagatcaagtttcaggccgcgctggaggcgccaggggccggccacaggcccaggagaggggaagaggtggagcgggatctaaggcagcgctgcgccgacgagaaggcctggcgctcgtgggcacagctagtgcagcggtccccacggggtggggtggagagaagttcactgggcacggtgggtaggggttggtggggttgcaggggggtatccggagagagaaacacctccaagtcactagagtatttgtctttcgctcactcgggccggggaatttagtcctgcaaggggacaggcggcggcggggatatgctcagaacccaggcgcttcgacagccctgagcgccccttgtgcgctcttcacccctccccaccccgtccctttgatatactaccggatctaggccattgttacggggaggggtatgtgggccgaaggaactcggggttggagacctggagcttcccagcgcgccctggccctggcgctgcggaggcctcgggtggagtgctggagggctcgccgctgcgcatctcctctgagctggcagccagcgggtgccccacgctgtcaagcggcggcgggtgagcttccagcagcacaggcacactgtaaacagccgcgtgcacgccctccccgcccgggctgggaacctcacccaaacaccacgccgctttctctccggctaccgggcgaggcttttgtggccaagcctaggggaagggggtccccaccccacccccaggccacccgggccccggagccagcgttctgaatctgcaggagtgcggggtgctgcggggaggggagggagtcagcgcctgccccctcctcactgaatgtctgctttgttccggaaaacaagggaagcattaggcggctgcccccggggaaacacaaaacttctttttgaatctcgggaaaggcggttgactgcattaaggagctcccgagacagaatgaggaagggaaaagccgagagggcgggaggagacagggagacttccgcgggaggccgatggtcaaagtggggggtgaaaccgctcagggtgaccgggctggagacccaggaacccgattcggcgcgaaggtgccgcgcgagttccagcgagcagcctgcccggccaagtggcgcctgcccagccgtcggccgtgccagcttcctgccctgcccaggaccgcggagcagtcggggacgccgccgcaggctggcccggaatcgcaggacagcggcggggggagggggtagccaggccgcaagtaaactcgcactagagctttctgcacacctccgccctagagagggggcccggacccccggtctgtgaggcgtcggctttggccttccaaccttggggtgcgcgaggaagcaaagacccagggggcacccccaccctcgcccaaggcccgagggtgggggacagctgaaatgtctttggtcttgtttgatgaccgcttggcggatctgctcccatccgggttctgccgttccgagagtgccgggtcagtgatacccaggccggtctgagcaggcatgtggatgagcaaaagcaaatctgtcgctcctccgaccgccacccctcacttaacctttcctgcatccaaggaaggggagggcacccagactctgccccaccccccgcggggcgctccctctgcctcggaagctgagactaagagcgagggttttccccctttcccctgggctcgctgggtttctaacttcctctaaacctccctcctcgctccgaaaagccccgaggagaggagctgagaggaagcacgccgctagtgtgcaaaatgaagaccatgtgtgaggacggcggcatcagagtgcagccgcgggggttagggggtggcaaaggcccccgcgcggccggaggctcggggccgcagcagccagtgcctctgctctgcgttggggactcggagccgcagcgagaggcagtggagaggcagggctggcctcgtggcgggaggcgaggagggggtgcgagggctgccgcgccgtggggggcagggggcggggacgcagccccggcttcctgggccgcagctgcgaccgagggcgcaagagcagatcgtgctctgcggcggtggcggctcgggcccgccgctctagcagctgagaatcaacaaagggaggcggcgggggaggggcgccaccgagcgttcgctggctgctctggaataataaaaaataattaataatgataataagagaaaaatcccccggctttcatggctctgggtttccgtgtggctgcagcgggaagcgcgctgtccttgaggcggcctctctcgcctggcctgcccgcccctccccctcctcgccccctcccctccccaggaaccgggaagagaaaggtctgcagctgacaaatattatccattctccccatcgatcgcggagtgtacagatgtgagcgcttgatgtgcccgcggagcggcggatcctccctgctcgctcgctctcgcccaggctccgctcgccgtccccctcctccccctttgttctcctcccctttccctctctttaaatagatttcagggcgctgcctgttggagagcagctggcgatctctcccgagagagggagcgagcgaagcccgaggtgccctgtcaccagcctcccctcccccacctcggcttttctctacgtcccccccaccccacctttctccagtttccaaaatagaaaacaccgggaacacccacgtccactgcaccgcgagcccctgggagcctttggacccctcgtgctgttccttgtgtctgtgtctgtgcagaggaagggcagtgcagggaggggacccagggccgcggcagaagagccaagggtccggatctttccctggcagcagcagggacgcagcgtgggtcacgctaacagggtacagtttacccattagggaaagtcggcggagacggccctgttattcctcttttgcagatggcagattaatccggcagcacccggcctcaaagggaccggctgctcggcaaagggttaacccgtcggccggtaatcgtggacacgcgcgcacacacacacacgcacgcgcgcgcgcgtcctctccgcctgcccgagcgcccgccgcggcccgcagtgcgcccggggctgggggagtagctgcgggaggggagggggtcgggggaggggcggggcgggcttaaccaggccgctcgactgagccggggccacctcgccgtctgtcacttaaatgattgtcctccgctccgctcagtgcggtcagtacgggctgttaacaggcagttgcaatcagtttccgaaaggtcagccaaggtcctccggctctcgcagacggaaggcattacgaaaccgcttttgtatctgcaggcactttagaaaaagaggcgagaaggggcgcaccgcagtgccgcggctgctgcgaccgggggagagggtcgggggctgcggagcagaggagtccgcacccccgcggccagggtcaggcggcgtggatatcacccgcggagtgacccagggcctccgggtttcggtggggaagcaggaagggggtggggagcaggcggcaagggaaggaggagtgggaggaagtgggagaggcgtcctggctcctctcctcacccagccaacagcccacacccggacccagacgggagcgggcggccttggacgcgaggagaccccactcggactctcaggccctcctggcgcctggaagtagggagggggtgtgggggggggaaagaccctcgccgagcgagcgagtcccagcgcggtgtctgaagacgctgctgccgccgccgctagaagtcgtccatcagcaaccagtccaacctgccagtgataatgtgcgatcaacaccaaatcacccccgccaggcgcgatccatcatcgcagcgcgccgcgggcccgcgtgaggctgactcgcggctggggtggggagggggggcgcgcggagcaggaggcggtcgcccagcacacccggactctccgcgcacctcgctgcccctcctggaggcctgcacccaggcgctcataactctccaagttccccagctacagagcgaaaacccagtggctccgagttctgggcacagctcacttaggaatccgcgcgtcctccgcgccctgctgtcgtggtcacaccctgcaaagccattccagcctcggagctgccctgcccatcccctccccctcctccgagaaaccgtggctggcaggaaattaatatttaatatcgtgaaattgattaaagggctggaagccggcgatgggttggggggaagggtagggactcctagcgtaattaaagatctgagagtcgtggtcgttccttgtcggccctggccgcacgtggcctttgtgaagccgaggcggggtcggactgggctgagcctggcgagccggggtcaggagcccgtgcagcttaggctctggcccgcgcggccgggttttttcggggcgggggtagggctggggcggcacagcagcggcaggggatgaggaggtgaccttagggcacccggggctgcgcgcagagccactcttcccctgcccgcctgcaccgtgggccactggagcccgagggtcgggtgctacaactgctgtcttgcttgtacagcacagaagcgcctttactgaccaggtggcctcgagggcgcaccgcctaccccccaggccccctttcagcagcctcactctgggccccgcttcgaggcgcctccccaacccctgacaggagtcttctgagccccccacgcagcccttcgggaggggagtcaggttcacctttccccctgcaacttggaaatcctagggcttaggcgccccggggccccccgccggttctctcctgtccaggccccagcctggtacgctcacgcctggggcagcttaactcgttcagctgcgctgcagatggggcctgctgctcgaagccgctgtctccagggagtcgtcaccgaaccagctcggccagccgcctgtcgtgccgtttaaggttaccgcgcttcccgcgaggggcatcgggactggaccgggcaggaggtgggtgcagctgaggctccctggccacccgagctaacgctaggagaggaattcggtgtgcaaaaggtcagcggtaacccattggccctggctacagtttagaagtcgaatggttggcttggtggtggggtgaccccagctcacggaggcctggctccaaagggctgatgtgaactttttcttgtatctgattttttagtgaagcactctgaaaagtaccaagtgtgcagaggggagaaaacacaaaacacatcaagctgcgtccttggccctaatcaggggagcaggaaggccctccagactccaggccctccagactccaggcccgctgtggggaaggtcaggaccacagaggattaggcccagtcttgggtttattgctgtacttgaacaaagtgccgggggctgcctaaactggagcaagagagaggtaattaagagggcctgcagaaggaagtaaaggctggtgtggctgctgcccagggtaggtggaggaagtgttttccataagaataacaagccggtgcaaatgttatgcagaaagactatttcaccaaaacaaaaccaaaaagttcacattctgcctctcaagctgagctgataaacaacatgcaaactttggttggaaccttgaaccagtgggaggtgtcaacccagtttacaaagggtaatggggaaccgtttctgggtacttctctgtttctaccattgtgattctacctgcattagctgctccctttgggggcccttctgacctcccaacctgagcccagcgggagatcactcagaatgcaccgcattcatcaatgccatttctggtaaattggacctcaggttttggagtgtcctaggaggcaggcagcctacactgcgcgcataccgatgtcacagcaaatgtgaggaaccgcacatattctgtagcctttactgcctttactagagaataccgtggatttcacaaccagaagtagcagattttccaagacattcctgatttcaagtgctttgagccctgtgtttttacggggcatgaagccctacctgcggttactaatgtcgaattgcgcaccagaggtgtcccagggctggaagaaatggcttgggtgtggggctggcacccagtggtccccgctggtcccctgtccaccatgtctagccaggcggccatcctcctggccgtcccgatcccagccggggcccgtccaggtagggctccgggcagggggcctgtcaggacgaagtggcaggactggccctcggggtccccgtgggtaaaggaggagcggcttcgcgccctgggacagcgcgcgccccggctgacacggggctgtcgccgcttctcccccggacgcgggcggctgcgcaccggccgccatcttggcccggctgcgcaggcggcgctgcccccggcggtaggaccgcggagccgcaggctgggccggggctgccgcgcgggcgttcccgggctgccggggggcgctccctcccgaggcccccctccccgctgcgggccacgctgacccaggtcggggacgatggggcggccgtccctggtgaaagcgtggcctgtagtgtcgcccctcctcgaaacgctggagcggattttaatcctgagaaacgacctctggttcccggactcccgcgatggtcaacgtgttatcgcttctcccgcgcaccccagaactctgtccccagaggcaacctgccgaggcagctgggggtggggggcgaggcctacccaccgttcacagggcgctgttgaggccagagaggatttgagagttaccacggtttagggctcctgattggagaacactggaactttatttgtccactttttgaatttaacatgcatttatggagcgcttgctaagggcgaggcgctgtgttaggacctagggggatccaaaagtacagaagtgaatttttaaaagacacctttggccccctcaagtaatttacaatctagttggaaaggcagacttgtaaatgactgaacacaaataaaaggcaccgtgaggtgaacgtaaataaagggcatgaatcttgcagtaaatggcctgggtaaaggccaattattttaaaaataatctttatttctaaaaatgtagaatcagttcgggggggaggggagggtaaagatttactaatactgaatatttccacggttcccggggctaacagtcattacttctgaaaagttgttgtttaggaaaaatgatgaaagtttatttcaaccaagcaaaatatcaaatatcagaaactctggattaatttctcagctcttgacattagctgggtgggacagacacaatttcccaccaaaacacaataccccatttgaaatcagtaaaaactcccaccgcatttcataaaag

SEQ ID NO: 9525 - DNA, 2305 bp, artificial
  synthetic oligonucleotide
gtttgctttctctttttcaactagccaggtattgtttcccataaaacagacatcgttaaggctgtttcacgtcactgtaactgacaaccatgccgaattaagggaagagattaatatgaacgtaacgtggctgccctggaacgtcatcgggcagtcccaagccactctgtgcccggcgcctgtccctgcgcggaactccacgtgtgcacaaaatgctctggggaggggaggatcggatgggttaaacacagtccgcggttctagaaacgaaaatacatttccttattcccgccctgatttaatcctgctgcgtgttattattgtcaagtctcttcgcaccactgtttctaaaaagaaaacccgtgggtctgcgcggccctcagccgcctgctcggcttttattgtgcacgcagcctggtctgcgtggatccagcacgtcgtgaccgcctcgcaggcgcgcacggacaccctcggattggcatttctataagagctgggcgcattgtctctgcggcgacacacacacacccacacagataataaagggccacggactcctgaccaaccctcctcgcaacccataattagagatgacctttgcgaaaggcaattaaaatatggtaatgatcgatgggctcgcctgtttccaaaaaggaaaatacacaggtgttggcttcaggaggctccacctggccgggccgcgaggcctcctacagctcatgaatgaactctttctcctgggaagcttcgattccccgctacctacgctagcgctggctcctctcctccctttcccctcccccaccagagctctggcagccaggagcttgctggcggcggcggggctttgtcatcggaacgcacacacagacacgcacacgcgcgcacccggccaccacgggaccgcggcagccgcgtccttcctcgctgcgcttccttccctgccccctcttttaaagagctcctccagaccctttcttttcttccgtcctttatgtgtgcggtccttttgcatcaaggagctcaggaagcattttaggggggccttccgcggagcgccggacagctcctgggaggcagaactcaggaccctacacgcgcggagaggacgcggggacagccgggctttgttttgtctcttgcctctgccgggagggcggagaagcctcggccgagctggggcccactggcgaattggcggcggcaaacacccccctcctagcctaagtggaacctgaaactccggacttggtccgggtggggcacaaagctacgtggagggtctcccagtccacaagtggctctccccacacagacaaatgtgcagtgtcattatggtggctcctgttgctcgaggcctcgggggtgctccggcggtgcgcgcacacctcacctccacaaggcacggagggcgagaggggggccaaggggctggggctccccggggggctgcctggaggagacgccacatcgggccttcccgcacccccggctgccttcctggaccgcgagcacggagccagggcggcctctcgcctttcattacggggcctacgaaagcagcagcccaggcaaatatgtagctattaaaattaatcgccccgcgttgtcagctgaacataatgcaaattatttatgggctgtctgcgcaatatttatcatcgtgcaggctccaggcgcttcgtgcctcctggcctcccccgcccgcccgccctggccggcgcagggcgaagctgcgcgcaggctgcagcggcctgggggctctgggaacccgagtggggttccaagggcgaggccgtgcgtcaggccgtcttccaggccgagggcctcactttagtttctgccattcagtacacatttatcggaggcctattacgtgcaaaattaggaggtccgcgaaatcggggtgaaaaccaatttggagaaatctaaaccaaacagatgagctcgggctcgaggggcgatgcagacagaggctcctcagctgcacaagagaattttctctggctcaagtcggtccttcaacctgggaaacccatgtttgctaaagctggattcgctctaggagaaacagggagcatctgatgtgctcaacagattcgagtacaacgctatcgactggaacaggaattcggtgtccttcgagcctcaaaacttgtttgctgatcgcagataacagattaactgttaattgtcgaaatcggccaaccatttagtttatcactgttgggggccccttggtattcgctgcactttttatatgtaaaaacagtcttggtacctcctaaacggcttttgtgtggct

SEQ ID NO: 9526 - DNA, 1331 bp, artificial
  synthetic oligonucleotide
tattaaggtcctggaaggtggaacgcaaaggggaccctgtcttcttaggacacagactggctgcgccgatagtgctcagccccgcacctcctgagcatacatttaatgttaggcaaagagcaagtttcctatctaccgtttgaccacagtttctcacagtatttctaattgattcaacgtgtattagattgaaacaaaaatgatcttggttggaatatacacgggcaacctgtatttagatggggtaagttcctgcagctatctgaccacatttgtctggtccctctgagaatccacgttttctagcccgagaaggggcaggcggccctcatggcgcctccttcggcggtttcctggcgaagcgcccatcctccccaagcaccaggaacggaggccgtccatattaatactcgcgggcagcctgttctgacctatactgtcattttttccatcggtcgggatcgggctgggggtggggtggggcgggggctctcctccgaggggctcagcacggatcgttgggttttccccggcgaacttaacacggaggcaaaaggggcagatggaaaccaggccccggctggccccgcgcgcgtaagcgcggcactcagcagctcgacgcaaagccagggctggattttcgcggcccgggcccggcggccgcccagcgcccgcgcgatcctctctccttcgggttgagcaaacgtggtcgcctaattccgcccgggagacagcagctgtgcggcgagagggggagaaaaaatatcgcaacttttccaacagaaagtgtgtgcgcacacgagaggtgaaggcccaccccgattctgtgcacgtatcgacacagcatctaatcagtgtcactgccaggaatacgcttccgcggcgggcgacaccgccgccctcgccaacctgcaggagggaggggggatgcaaatggcgtctcgcgtcgtcctagactccgcgcagcacccgctaccgcgactccaagcagacgttgcagcaaactggggtgcagcgtctggggacgcgaacgcgcaggcggcccgagcggtcgcagggaagaggaactagcaccactccccgctacgagaccgttccccgcccccacctccggaagagccgcccttactcgactggggtgaggggcgggaaactttgcaagaagactgttccgcgccttccccgcgtggcacctcagaagaacgtgggtgggtttcccgtccgaggccagaccacgctaccctacttttccaggtttcggacctgaacctcgtggactacgggagggagagtacatttcgggccactgcggggggcggagggacaccaaa

SEQ ID NO: 9527 - DNA, 246 bp, artificial
  synthetic oligonucleotide
gtgaggaatgcaggcagcttcagaccactagcaagtctttggactaaggcctgcttcactcactttccagcctcaatttccttctttttcacttagatttacaaagagagcaagccctgaaggaaaatgaaaatgatctatccatattttgggggctataccctgattcccctgtgagtaatatttcttctttactttctgtcttattttggcttagaatgcaagcccatgaaaagtaggcttccg

SEQ ID NO: 9528 - DNA, 1363 bp, artificial
  synthetic oligonucleotide
ttacaaaaaaattttactcacactaacttcattaagacctcaaacactcaaaagttccagaaaaaaagtactttgaattcaaatttgtattttatacacaacgtatgtagctcctgcattaacttagaagcaataacagcttacatttaaaacgtatcgtcaagaggctgtaatacaaatttcccatctatagagttttttctaaaagctcgaatattatgtattccagccaagaaatcaagagagttctgttgggaactcggacaaaaatttcacacaattttcagtggaagtgtaacaacacgcaaaattaacaagtctctgttgcatcgttgccaggaagaccccagatacaaagcttcttctccacctctgctgaaccccaggagttcaaaaattctagactaagcagtccagcggagaacacagcagcctctcggggagagggaggtgcaaacgtctcagccggttgggcgggaaggggggctggggaacaggcaggggtttcggggcacttacaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccgggccgcctcagaacaggaagccgtgcgccgaccgcggaagcccgcccccatgtagcgagaagtccgccgaccccagggacaggagcgaggggcggggggaggcggggatgggggggaagcagggcggccccgcagaggggaagctgcgcctccgcaaacgctcagaagcagcttcgccagacagccgcaacgtacatgttgactgcccgaggcggaagtcgatcggcagagcggaagggggacctgcagaggaccttccgacaggtctgtgtctgttctctcagctgtctagcaccgcagcgctggggggcgcgtgggagtgaggcggtacctgtgagcgcgcgggagagcggaaaagggagccgcgcgccgccggaaaccagggtgagggctgagccggagtcgtcaccgggaacgtcagcagttgccccgcccttaccctcgccgctctccctcccgcctccgccccctggcgttgtaaaggcgacaatttgcccagagaaatccaccatcgc

SEQ ID NO: 9529 - DNA, 723 bp, artificial
  synthetic oligonucleotide
tgaagtctgaaagggggaattccttttgccaaagaggaatttcaagcatctgctgctggtcactgaggtgaatttttttgaaggggccagaggccgtttcagggagcaactaccaaatcatcccatagaaggaggtgattttattttggtcataactagcgacaagaactatcttgaagacttgagcaaagtccctaaggaggcctgaatttggaaagacaatgggagtgaccgcactagcatttaaagagacatttttcgttttccattttccatagctaaatgctgtggttgaatctctgccccttccccccatgtttttgtgtgagagaaattctgcttctgctagcagtgcctgggattctgtccaaacagtgtgctgtcagcagcatcagccagcaggaacgcataatcctcccaccctttggttttagtgggtaatgttaactaagaaaatactccagatttttcttgttctcatggtgtaactcactcacttcagacatgcccccttctccagtagttgccccctatacttgaggaaatttttgtgtttttttttggcaatacaatagccaattcaggaaactagtcagcatctcccaggacaaaaaggcagcttttcagactgcaatgtcactttctttcattactgtcattccttgggtcaaaggggcacaatgacctcaagtttttaagtttttaacatttctgagatcgaat

SEQ ID NO: 9530 - DNA, 475 bp, artificial
  synthetic oligonucleotide
aatttagagtgttaaatgtagtttaggatggtggtgctggtggtagaagggtgttctttccaactcatccagccagatttcccagaaataaccttggacagctaagtgtggtgaaagattgatggactgcatgattataccaggtctgacacaggatatagggtgacaaactgtcctactttgcctaggacccaggggtttcctgggacacagggctttctctactaaatcaggaaagtcctgggcaaaccaggatggttggttaccctatccatctctgaccctcagtgaagttctgatcactgttataaagcttttcccaccaaacagacaccattggtaaagggggcaaattggacctcagaggatgattctaggaaaagagaagggaatcactgggtatataattttccttgaggccatcaatagatgggcaagagaaggaaaacaggctttacctggctcacaggcacct

SEQ ID NO: 9531 - DNA, 465 bp, artificial
  synthetic oligonucleotide
ttgtagatttttaaaatttatttcaaatagaaaaagttaaaagtaaacttgagtttgcctacgtaattttttatcttgaaatattcaaaattaggagccagatgaccaagatgctccagatgaacatgagtcgcctccacctgaagatgccccattgtacccccattcacctggatctcagtatcaacaggtaaacaggagtcagtttatgcttttatcccctagaactgggttttatgcttaattttagaggatggctcaattgtttgttgtgactacaaagtaagaagtaggattatctagactagctttgggagcatgatccagaagagggatggtttggagtgggggtcatggtgtaacatgtttgaacttaaccactgtagggttttccttgtcaagaaggtgtccttcttgtgctagtagttaataaaactgtatgagaatttatatcaacataaaatg

SEQ ID NO: 9532 - DNA, 7442 bp, artificial
  synthetic oligonucleotide
aagaatgtattcttatatgaaagaatatcagtgaatcttgttgattctcactcccaaaaattcattggatggttttagttcctgattgacacagaagagcccagcaggcaggccctctctccttccatgtctataatcagatggcctcttaagccaggcccccctctcacattctggatcctgtggtgctttttgcccctgcacctttgtcccactaattttgcctttcttctggcagtttctgttgcctaaaactctctttgtgctccttcctgcctggccattcccttcctggcccctgggactaggccaactctcccctcacccaatcactccctgctgtttgtatctaaagcagtattttgcagattagcatgagatttacctcatagtgttattttgacttcccaactaactgtagacaccccttttaaggtgcccttgtctctggcattctccctggctctaggtctgatactggacacagtcatttatggagggcttgactccataggatcctgaaagcctggccaagcaatttagactctgtgctagtgggacattcttaagcaaggcagtgacaaaaccaagcagtattttatgcagatttgtgttggggcaggagagtaaactaaactaaatgccctttgcaagccctacgaactgtggctttctctccatatctggttaatgctccctgtcttattaataaatggacagtatacatttactgcacatttgcagctggcgttcagaataatgattacaaagtcattgtgcaggccttgtggcacgagactggacaacagtcagcatggtggagaggaaaatgtactgaagagatctgaaaaatcacatgcaatcgctatgaacagctttatgccaattaatttggaaaacttgatgaaagagacaatcttctagatgtacaataactaaatcaattaagaaatgggatatcagaataaccaataacgctttttaaaaatacgaaacagaaagccaaaaatctctcccaaggcccccaccctacctccacaaaagaaagaaaaaagaaaggaagcaagggagagagggaaagagggaggaaagaagagaaccaggttcagacaatttcatggatgcgttttacctaatcttcaaaaaataggaaatcctacctaatgtaaatggttacagaaaatagaaaagagggctgggcacagtggcttacgcctgtaatcccagcactttgggaggccaaggtgggtggatcatgaggtcaggagtttgagaccagcctggccaacatggtgaaaccccgtctctactaaaaatacaaaaattagccaggcgtggtggcacacacctgtaatcccaactatctgggaggctgaggcaaagagaatcgcttgaacctgggaggcagaggttgcagtgagcagtgattgcactccagcctgggcaagagagcgaatctccatcaaaaaaaaaaaaaaaaaaaaaatagaaaagagaggaagctgcccaattcattttatggaactattagaatcctgatatttggtctacggccataccaccctgaatgcacccaaacccatctgatctcggaagctaagcagggtcgggcctggttagtacttggatgggagaatcctgatattaaaacaagaaagtagagtatcaagataagaaagaaataggctgaactcacttatgaacagaaattcaaaaatcctaaataaaataatagcaaattgaattcagcagtgtgttaagacactaaaacatggccaagcaggattattgcaagaatgcaaagatggctcaacatcagcaaatctaccatgacattcactgtgttgatagaagaaaacagaaataacactggtatgggcattaaaagacagacttaagttccatctctgctctgccattaactagctgtgtaacattttacctctttcctatccccacatgggttccccagctcttccctgaggaggggagcacagcattgagaatcagtctgctcctctccctgcctcattttcttcatctgtaaaatgaagaaacattcgaattccatgattttgcaggctttgtgaaggaagcatgatgaagtccaacaaacagtgagggaaatttgctgtgtagctgggtcctggctaagtcattgcatccatagtgctggtggctgcctcagaggagatcaagctggcagtgccaccctgtggcctattgggaagtgcataaaaagcacagacaccatcagggcagactgcagaccagaagaaacactctgtaactaaatacagtggtggatgagggaagtcaccatcaccacgtgaagtagttttaaacataaaacaaaatctttgggagccgaggcgggcggatcatgaggtcaggagatcgagaccatcctggctaactctactaaaaatacaaaaaaattagttgggcgtggcggcaggtgcctgtggtcccggctactggggaggctgaggcagcagaatggcatgaacccaggaggcggagcatgcagtgagccgagatcgcgccactgcactccagcctaggcgacagagtgagactccatctcaaaaaaaaaaaaatcaactctgctcaagcctctagatctgcattgtccaattcaatagtcactagccacatgtggctatttgaatttaaatgaattaaaattaaataggctgggcacggtggctcaggcctgtaatccagcactttgggaggctgaggtgggtggatcacttgaggtcaggagttcaagaccagcctggccaacatggtgaaatcctgtctctactaaaaatacaaaaaaaaaaaaaaaaaaaaaggccaggcaaggtagctcacacctgtaatcccagcactttgggaggctgaggcaggtggatcacctgaggtcgggagtttgagactaacctgaccaacatggagaaactcagcctctactaaaaaatatataaaattaaccgggcgtggtggtgcatgcctgtaatcccagctacttgggaggctgaggcaggataattgcttgaacccgggaggcagaggttgcggtgagccgagatcatgccattgcactccagcctgggcaacaagagtgaaactccgcctcaaaaaaaaaaaaattagtcgggcatggtggcgaatgcctgtagtcccagctaccagggaggatgaggctcgagaatcacttgaacctgggaggcagaggttgcagtgagctgagatcacgccactgcattccagcctgggcgactgagactctgtctcaataagtaaatacataattaattaaattattaaattaaattaaatatgcagctcctcagtctcactggccccatctcaagtgctcatagccacacaggatgagtggctaccatattgaaggatgcagatatagaacatctctataattgcagaaagctctattggatagccctgctttcactctaacttccaatttacaagagaatatcaaggacagaggaacatgtgaatctgcaccatgagtgtgcactaagcaatattcaggcaatgagaaactcttatggacaaactattcagtttctttaaaaacaacaaattgcaagaaaaaaaatgagatggagggtaaacctacagactaacagacttaagaaacatattagccaaatgcaatgtatggacttatttggatctcgattcaaacaaactattaaaaatgtataagatggccaggggcagtggctcactcctgtaatcccagcactttgggaggccgaggcaggcggatcacctgaggttgggagttcgagaccagcctggccaacatagtgaaaccccatctccaccaaaaatacaaaaattagctaggtgtgtgttctgtgtgggaaacgtgagaggggagaagaaaagacacacacacaataccttcaagggtaaacaatctttatcccacgtaaatggcaatgcagatataataggcaaatgatataacaagcaaattgaaatgggaaggggataagggaaaagatatagatagatagatagatagatagatagatagatagatagatagatagatatacacacatatatatatatatttacactcaccagactatggaggattcaccaccagaccaggaagcaacagcctgggctccagagtcagacactacactcaccagactatggaggactcaccaccagactggaaagcaacagcctgggctccagagttggccactcatcagtgcacagatgaggagaggtctcatgaagcttcggtgcagtctgggaccctctttttgtaacgagttgtttagcatgaggcccagtcatgagggccctttgggactgggctcaaggaccacaaaaaggtcaacttgtttttgtgattgtctgttgcttttctttttcttttttttttttttttttgagacggagtctcgctgtgtcgccaggctagagtgcagtggcgctcactgcaacctccgcctcccgggttcaagtgattcttctgcctcagcctcgcgagtagctaggattacaggtgtgcgccaccacacccagctaatttttgtatttttagtagagacggggtttcactatgtgggccaggatggtctccatctcctaacctcgtgatccgcccgcctctcctcccaaagtgttgggattacaggtgtgagccactgcgcctgtctgttgtttttcaataactaatgtacaggaatagattgaaatagagatttctctgaaacagtgctggatgaatgcctcaaggggctcacacaaactattctgggacttggtgaccattgtttttgcccatgttcaactgagttcaagtttaatatttaacttttccatccgggcatggtggctcacgcctataatctcagcactttgaaaggctgaggtgcgtggatcacctgaagtcaggggttcaagaccagcctgggcaacatggtgaaaccctgtctctactaaaaatacaaaataagccaggcgtggtggcgcgttcctgtagtcccagctatttgggaggctgaggcaggagaattgcttgaacccgggaggtggaggttgtggtgagctgagatcacgccattgcactccagcctgggcaaccagagtgaaaactcggtctcaaaaaaaaaaaaaattaatatttaacttttcctccatagtgtggtggcacatgcctgtaatcccagctacttgggaggctgaggcaggagaattgcttgaacccagggggtagaggttgcagtgagccaagattgcaccactgcactccagcctgggtgacagagtgagactcttgtctccaaaaaaaaaaaaaaaaaaaaaaaaaagtataagacaattgggaaaatgtgaacactgagtagatacttgatgatatgaaataattattgttatggtgagtgttaatggtactgtggttatgttcttttataaaagtccttagctcttagagctatctttggaaaaatctacaaatgatatgatatctgggatttgctgcaaagcattctggacatggaggagtgggtgaaggtatggaggcaataagattggccatcggtttttgtgtttttttgttttcgttttgagacagggttttgttctgggctggagtgcagtggtgtgatcacagctcactgcagccttgacctcctgggttcaagtgatcctcctgcctcagcctcctgagtagctgggaccacaggtgcatgccaccatgcccagctaacttttatttttgtagagatgggggtcttgctatgatgcccacgctggtcttgaactcctgggctcaagcaatcctccctcctcagcctcccaaggtgctgggattacaggcgtgagtgactgcactgggccagccatcagtttttgaaatggggtgaagagtacaatggggtttattttactgtttctttatttggatatatgttgaaaatttccataataaaaagttttaaaggctgggcatggtggctcacgcctataatcccagcattttgggaggctgagacgggtggtttactcgagctcaggagttcaagaccagcctgggcaacatggggaaaccccgtctgtacaaaaaaatgcaaaaaaaaaaaaaaaaaaagcaatttagccaggtgtggcggcacatacctgtggtcccagttacttgggaggctgaggtaggaggatcacttgagcccaggaggtcaaggctgcagtgatctgtgattgcatcaccacactccagcgagggtgacagagtgagaccctgtctttaaaaaaaaaaaaaagtttgaaaatgttcaaataaaaatgtgtgcataagtatgtacagctgctttcctggtcgcactacatttaccatagaaccgaatccaagatagagaagagagatgttccaggacggcatgcccattgtaggtggacttccagccacttggccaactgcaaggaaaaggagagaaagaaaagggaagttggggccgggtgcggaggctcacacctgtaatcccagcactttgggaggccgaggcaggtgaatcacccgaggtcaggagttcgagaccagcctggccaacatggcgcaaccccgtctctactaaaaattcaaaaattagccaggcgtggtggcacttgcctctagtcccagctattcgggaggctgaggcaggagaactgcttgaacccaggaggcaggggttgcagtgagctgagattgcgccgctgcgctccagcctgggcgatggagcaagactctgtctacaaaaaaaaagaagaagaaagaaaagggaagttgggatgatgatgagaagagaggggaaaggagattgtggaaagggaattctacatgatgagagaagcataccagaagggcccagagaagggtgcctgggatagtgagatgcctggaaatgcatgaggttggaaaggaccttaccgggctccattgcacagccctgggatgccctctccctcccagtttcttcacccaaaagcctccatctgctttttgaacacgtgactcagactgtatgcccactgggaccatatgcccacagtgcatgcacactgtatgcccacagagactctgggagcaccgcccagataactgggggcctctttcaccagttctgcctgccagtcccctaactgctccagtggctgttgctgatggttcacacctgtgaccctctacagaggtttgccctcagatgattggagccactcagacccgaggtgctctggagctaggcatcttcagccactgattggtatagaggcatacagtctcctttccctggcttcggcgcagaacagattctgagatccagtgtctgctccagagctccccgtgggatcaggcctgaggctagactcctggaaccacatccttgctaaccttcttctctcctcctcctctc

SEQ ID NO: 9533 - DNA, 1483 bp, artificial
  synthetic oligonucleotide
gatgcccttcctcactttgctcagagctctgggaaatttctgggccctcttaggcagttctcttgattctcccagtcatgaacaaaggcccccgtcccccactgggactggaactctttgttctggaaagctgagtactgcagggcaggcctgggtcagaggccactgcctggtgttccctcggggcagagtcccctctagccacactctcactggcttctgaaagaggaaggctgacgaactgggtgactcatcccatttctggaaaagagaggatcaggagttcagatgggcatgtttatgactgacgtctggatgagatgacacgataaacataagggcttaacaaaatttagcaaagacttgggcagcagcccatgaagaagtgtttagtttttctattaaaaaaaaaaaaaagccgggcgccatggctcacacctgtaatcccagcactttgggaggccgaggcgggcggatcacgaggtcaggagatcgagaccttcctggctaacacagtgaaaccccgtctctactaaaaatacaaaaattagccgggtgtggtggcgggcgcctgtagtcccagctactcgggaggctgaggcaggagaaccgcgtgaacccgggaggctgagcttgcggtgagcagagatcgcgccactgcactccagcctgggcgacagagcgagactccgtctcaaaaaaaaaaaaaaaaaaaagccagccgagcgcagtggctcacacctgtaatcccagcactttgggaggacgaggcaggcggatcacctgaagtcaggagttcaagaccagcctgctgaacatggtgaaaccccgtctctactaaaaatacaaaaattagccgggcttggtagcgcgcctataatcccagctgctctggacgctgaggcaggagaatcgcttgaacccgggaggtggaggttgagggagctgagctcatgccattgacctccagcctgggtggcaagagtgaaactctgtctcaaaaaaaaaaaaaaaaaaaaaagccttaattccaaagccacaaatgagcctacaccattggctcatctcagcctaagaatccaattccaggaggtaggagagggtgacctgcggtggccgagaaggatgtgacggctctccgaggtgaacaaccgttcattctcaatgaatagtttcacatggacccatggacccatttcagggatttgctgttctttaaaacacggcagaaaaaaccccaaacaaaaattcctatgtacaccagtcaccccttctctcttctgctttttggctaacatcaggccagggacacatggtggccctagctcagtctttgctgggacttggtgacaagcccagggacaaagaaaaccagtctctactctgacctaccccaaagggtgcccattagggacggggcaaataaacaagctttgagatttttacatggaaatctcaagggaccaagatttcactcactctg

SEQ ID NO: 9534 - DNA, 760 bp, artificial
  synthetic oligonucleotide
tattgaaattttaagagttatcaaaattattaagcagtcatgtttttttcctatgggcgaaaaatgaggtttctaggtcatggcttgctttggtttggtcacaatactcaaaactagaaacctgttgattgattgcaatatttcaaagtgaatttgttctccaaatgtcttacttttgaaaagtgacaagcagatgagggcagaattgttgtttgcttaaaccgagtgttgtgaccatggtaactgagtgaagatcacgagaatcctggagaccagatctctgcattgaggtatccatggaagtccgtggctgacatgcagcctgggttactgaggaacaaggtgctgccttgagaggaatgtccttcctttcatttggagcgggtttgtgagagtcagcctcaaaatgctgctccggttctgcctgagtggttagatggccagctttttaatggacatttgcttggctgaatgtttttgaaggagtatcagcattaaaatagcctccagggaaacaggtttttatagagctactcagcccagtagaattctgggaacgtgggagctacttactgccaaacagacccagagttgcttggaatgagttgccagtgaatttgtggccgttatgagctctcgtgagaaaacagggagtgaagactttccattttgagttcatttagtctctcaccccatcactggctacatggtaccttaagtaaatagtaggtactatagattctgttaagcaaaactatgt

SEQ ID NO: 9535 - DNA, 1283 bp, artificial
  synthetic oligonucleotide
ttcaattggtaccagggtaccagttaggtacctgctgacagtttggatgatgctttgaaactcaacttgactcctaccacttcctgggccaagccactcaaaatgggggccttaacttgggaataatcagagcgaccatggccagtcccagccatcctgagaaggttctctccatttagctagacgaagactacccaattctggagaattagtgttcaatcttcgggaagatgcctgttgtttggttcaataatttgctcacagatgataggggaaaaaccatggtagaaagaatgtagaggaaggctcttttatttcatgtaaatcagtagaaggtaaaaaggactggagttaatctttaatatacaccaacttcctaaaaatccttgtttttgctgatacttcttcttgacttttaggactttgaccacaaaattttaagaaaaggaaacaaattagcaaactaaattaaatggcagtttgagatattttggacaaatatttaaatattatatattttgataatacaataaaaccttcctaccagaatctcagggggagaattgttctgaatagctacatttttaaatacattgtgatttgaatctttatgcgcacaatcctttttgttttaataatttttttgcagagtctcactattttccccaggctagtctcaaactcctgggctcaagcgatccttctgccttggcctctcaagtagctgggattacaggtgtgagtcacagtgcccaccttagttaaataattttgtatggctttctacaatttcctgacttcttttacacagaatgctgctcataatttaaccttttcttgatgactcagagttgtcattgtagatactgattaaagacctaggctgtagaacagaaagcaccctcaggaacttcagaggtatgcaagagttgatttctttcatattgaaaggctgttgcgctttccaagttttggtgtctgctcagtatatatcatatatatttttgtcaggcttttatttcttttctctcactatgctttagttctgcgttctcctaatttgttgcttttataatctgctattaactagaacctgactagcaaccagtttatttcatttaatagcaatttcctaagtgcttgctaggtcctagataccctcagccatggtcccccttactcttacaaatcacagtctttgatgtaagtccctgcatccaatgctacatggaggtatgtagcccagatagttatgggaatatagagagaaggaatagggctat

SEQ ID NO: 9536 - DNA, 1052 bp, artificial
  synthetic oligonucleotide
caccaacctactttctgcattggaagggatatatcagagattcatcacaaacacttttcccagatattttcactttttcacagactctgttttagtagagattgattatttggtatttatactgtaaatggaatgaatgtgtgcagagccttgtacattcagtccctattttgtgatttcatataaattatactttcattcataacgctaccccaaagtcaatataaaattttaccacccagcaaactttttctgtaaagggccaggtagtcaatattttaggctctgtcagctacataaggtctctgttgctttcactgcttctgcctcttcttctttctcctcctcctccttcttcttctttttcaaccctttaaaaatgtaaaaaccattcttaggtctaggccttacaaaaaatcaggctgtggttggatttggatttggcacatgacctgtagttggccattgctgatctagaagaattcagaaaaaaaaattaaaatttaaatgttttctttgtgagttaagtaatgcatgactagcattagttagctggttgtttattttttctttttaaacaatagcaaaaagcatattcatggcagtgaggatgggccccatttgaatggctaatattcatctcgacacagctatttttgagtagttggtgatattctcttacaaaaaggaaagaaaagaaaacaaagctgccagacagtacttgaagcttgggtttattttctccaccactgcaagaaggtcttgcaatgagaaccaaaaaaattatattttctgatggcgcattgggaaaactagtggtgattgtaaaaatgtatttagagtttaattaaaacacagtcactgcagaggcttcataataatgtattgtttttctgcttagatttgtatcatcagtgtgctagctacttgtgctttacattgaccaagaggacatactgcacaagtatgtggatgaagattactggacttttaccttagaaaatatttctccgtaggccacataatgaagtatctccattaatttttctttt

SEQ ID NO: 9537 - DNA, 489 bp, artificial
  synthetic oligonucleotide
ctatatgaagagtactacctagcattatagtaaaaattatttcttcttacctacttcaaataagggtctcagggcatagacaagttatcttgaggtggtcctagctaattgttagttttctgtccattcaagcactcctcttagaacttgaagctgtctctgtcttgctggaatttttgagtcttagtgtccaggacctgagtatcatttcttaaatttatgccctacatttattcctcaagaccaggtgatcttcatacaaacagaacaaatggtaacctgccaacaaaacccagaattcaagaggtgggctagagtttagactcctctctttcttccattctattacactaaagttgtttatttctttttccttcctttattccagtaatttctggcacttttaccttttaatattttttcctttattccccctttataacaccccaccctgaagacatctggttacttatcgctatacttttatat

SEQ ID NO: 9538 - DNA, 364 bp, artificial
  synthetic oligonucleotide
aaggagaagagccaatgtattatgccgtagaaagacaaaagaagcaagtgagacaaaagaagcatttgggtgttggtgactgctttgcaaatattttaagagctgcgtttttgacttgttttcctttctagagatattaccttggtactatcatttatatgacattgccaggaagctctcttgaccagtgatgccttgttagcatgggcctccatgccaagaacagacattcaggcttccatgagcattttcagccaggggtaattgagataatctggaggctaaagtcagaatgagacccactgtgtgttcagccagtactgtacagcttcctaaagcttccatggcaggatttgtgtttctc

SEQ ID NO: 9539 - DNA, 597 bp, artificial
  synthetic oligonucleotide
ttcaaatattacaatttatagtgcctttaatacgtgaaaaaaaaattaaggaaaatgaggatgattttccatactattgcttcttgttacgcttgtctatagatgtgtacaaatcaccctaaacttagttgtagacaaaaaacaacaactatttattactgtttttcacagttctgggggttgtctggattcagctaggcagctcttgcttgagttatttcttgcagttacagtcagatagttgctggggctagagtcatctggaaggcttctttactcaaatttgtgcctattggtgctggctgccagctgagacctcactttggggttgtcagccaaatgcccatatcttgcctgtctgtgtgggagctttctcatagcatggcaactgggttctaagagcaaaaatcccaagagaagctgacagcccagtgaaagcctttacaatttagctttagaagtcacagaagcatcacattgttttgcattttattcataagaagcaagtcagtcaggccacaccatattcaagtagaaggagatttgactttgcctctgaatgagaggtgtatcaaagaagttgcagacatgatttaa

SEQ ID NO: 9540 - DNA, 1102 bp, artificial
  synthetic oligonucleotide
aggaagtctgaattaagtatgaactttaataatactgtgtcaatattggttcattaattttgacaaaatataccatagtaatttgtgatgttaataataagagaaagtggtgtgggttataatggctactctttgtattatcttcacaacttttctgtaagtctaaaattattctaatattaaaagtctattttttaaaacacccatttacaaagtgtcatattgtcaaagatagaagctatatacttggtggcagattgattactttggattactgtcctcatgggaatgaaaatgtcttattctcacagttattcacaaattattcactgaatttagatgccctagtgaccaatagagaaatcctttcaacaaagaacacagttatgaccccattagtgaaagctgagtgaggtacctggccattttgggcttatcatgccattgaaacacatgttaggattataaatttggcctccaagcccaccacatggccagcaccaccattttgtacctaaagaatgctttatctattgctgtggtatccacacagcattgccattatatatatatatatatatatatatatatatatatatatatatctcctacgtactgtaaaggaagtacaataatatcttccaatgctcacagagttcactggccttattaagtgctttcaccaagaagcatctggctttatgtggagtgtagtagactgctgaaggttcagttacagtgccagctgggaagaatgccttgcaactctcaatatatggtgctttcttcaccataattgtgtaagtccagaaattaaggagtacataaacaggaatggcccctctgttatactcactgaaagtatttttgcttcattcactgaatttagatgccctagtgaccaatagagaaatcctttcaacaatgaacacagttatgactccattagtgaaagctgagtgaggtacctggccattttgggcttatcatgccattgaaacaacaaacatagaagggggtcactatactgagaaggtgatttattctgattatcgggggaaactgggttattgctacacaacaagggcaaaaaggcctattt

SEQ ID NO: 9541 - DNA, 501 bp, artificial
  synthetic oligonucleotide
tctttatcttttatgcattgtattgctgaattggccttaccaataactttaccaaatgatggtgcttagtgatgagtgttagacaggattgtgccccagttcttgagtggatgaggaaagattgccattttcagttgctctttataggggagatgtaaggcacaattaacttttaaaaaaataaatggggttatttttttacaagacaccttttttccaagttttaactaaagtcctctgaccaatttttctctttttgcagaatgagcatgttgattacgtagatgttggtggagcttatgtgggaccaacccaaaacagaatcttacgcttgtctaaggagctgggcatagagacttacaaagtgaatgtcagtgagcgtctcgttcaatatgtcaaggtaaggctgacttttcacccaagtgactgatagggaagcattttatttgagaaaacatttggtttgtttttagttatttttctttcaaagcaattgtaaaa

SEQ ID NO: 9542 - DNA, 1415 bp, artificial
  synthetic oligonucleotide
acgactgtgttcttaactcctagaatcatgtcaggcacataggaggtgcttgatatttatcaaataaatattttctgtgtttttctaattacataaaagcaaaatacagagggttgataatacctttataagtttttataaatcctcccccaccccaaatattctggttctcttttcctttttttcagttagagatagctttttcactattggcaaaaagactgtctataaagtgtgtgacattgttgacttcggctttgattatctatgagactgtggcctcttcccacttgtttaagtgtcttggtaactctgagtggaaaaatttcaaagcaaagttgagttcaaagcaaatgttgagtgagagaatggaaaaaagtgcttttttccattctctcactcaacaacgatcaccacagaagacttctgtgaccaaatgtggagtggtttttccccacatattaagcaagcaagcaattctatagcagacatcagccatgtgtcctctgaattcaactcaattctgacagtatctacctggagataacttctgatcctacaggttgagggctcagtctccaagactgtcccccaccttcagatgtcagtcacaagtccagcttccagaatttctgaccaatctgcttccagttgatgttcctacaaccccttcaagtttgattgatttgctacagtggctcacagaactcagggaaacatgtttactgttttattataaaggatattacaaagggtacagaggaagaggtgcattgggcaagagttgtgagaaagggcatggagctttcatgccctccccaggcatgccattctcaaggaacctccagttgtgcagatatccagaagctcccagaactcggtcgttttgggtttttatggaggcttccttatgtaggcacaattgattaaatcattggcctctggtgatcaattcaaccttcagccccttgccccatcccctccctggaggctgggggtggggctgaaagtcccaaccctctagtctttccatggtctttcctgtgaccagccccatcctgaagctacctaggggctgccagccatcaatcattggcatcaaaggacatcactctggagattctaagaatttttaaagttgtatgccaggaaactgggatgaagatcaaatatatatttcacaatatcacagttacctcatacatctcatggtttagggtctccacaaggacattttctcttgtctggtcaatgtagatcacaggcctctccagcttcactcggtctccaaggaggtccattatccgctcactcacttgaccagatccgcccacaaatttcctctcctggaaagagaaaaggaggtgaaagagaaacgcaggaatgggcataaattgctaaattcttagttgtcc

SEQ ID NO: 9543 - DNA, 1249 bp, artificial
  synthetic oligonucleotide
taaatatcaccaatttgacatcaaattcataaaagaaaagtggtttttgtaggtagaatttagatgttaattgttgaacttttcaacacagagtagcaaggagaccctgaacagtaaagccatcactgaaaacagctaacattttgagcattgaccgtgtgccagctgctattctatgtgttttaagaacttatttatcctcccaataactatgaggcaggcagatgtagaaaatgaagcatagagaggccaagtaatgtgcacaaaggtcacacagctagcaagtagcagagccagtattcaaattcaggcaatctgactccagataacaagcacgccagcagccttcatcatatttcacagtgaaacattgcaaatcttccctttaacatcacggatcatacaagcatcagggccactgctagcacattcatgcatgccttcgtgtaaattgcaagaaggcacacactcctggctagtaaatttccaaaacatgtccttcattcaggcgaatgcagctcacaaggtgcatgcaaacggcttggctggcagagtgggggactgcattacatcccccttctacttcatcagccgaatgcccttgggcagggcaccacctgaacagcttatgctgtggccttgaagctcagaaaacttttatttcctgaacaataagaatttaattgtctattctttgtctcctcaatgctagtacacagttggcacttaaatgtttgttgaatgaatttatttaatacccttctacaggggtgacatttgattactgagtaaataaataaataaatggctgtagtgatcagtgtctgtataagtattttaaatacagtataagaaactaaaatacttaagacatactgaaactgatttcctctggtcatccagaaatggtaacataaacttttgactttttcaaagggaaagaaagacagtcagccaacagtaataaccaccttacatttgtacagcattgcacagttcccagcactcacacgcattcaatccttaacaataatgccatgaatctggcaccgttactcctatttttcggattagtaaaaggaggttcgaagagattcaagggtttgctcacagttatacacctagcaatggcagagctaggtctgaaacctggttctgtttctttgtcttaatgggtgttgcctcagccttattacctcctataacatacagagatccatgttgctaaaacaaaattcttgaaacatgc

SEQ ID NO: 9544 - DNA, 1130 bp, artificial
  synthetic oligonucleotide
ttttttttttttttttgccttgagtgttcaaattgaatgaaccaacactgttgtattgaagaagaaatgaaaacaaagcttaagaaaagagcaatgctaagtcaagttgtcaacattgtgttgctcagggtgtgcataggtgagaatgtgcaaagtatgggagtgggaggaagacctcacaaagaggaaaatcaggaattaagaaaatgtacaccactgagatcaccactttctggcagcctagaattatctctgccttgtagcagcttctgttgttttctcaaaactaaattaattccagtttgccttaattttttaagacgtgtcataaaatcaaatgctgcctacgaagacttagaaccttggcccaggcaataatggattgaacaagagaatgactctcttgctgaactcagtagccctgtggccacgctatgctctggatacagtctctgagacatggacttggccgacgtacagagcccacattctaatagctccaatgtggagcctctgccggcaggagaggcacgtaggctggcgtgcccgactttggagctaccttccaaatgataccagtggaaaagaacaactggtgcccagatttccccacctgtcatcctcagggaaataatatagcagagcttacagcgggcccagcctcctgggtgagagatggtgttgtgcccacagatcagctcactcttgggctgaccttctggctggcagagggtaaagtgctggtttcacgcaagttatctcagcaacaggctaagtggtatgtgccaagaatggccttattcttgccttgcttgccaggcacaggagggtggtgcttcagtatccatatttccccctaggctgttttcaatactaatgtatactgatattcccttctgtggcttctttcaacaaatattttttaacatgtatttattgagcacctactgtgtgtctccttttgctctagcagataagagatagggtcaggggaaaaatatagttcctatcctcgatccctcttctagctcactgactctgcaggcagagtcttggcctgttgttttcctggatggtttttagacacattgataaactctctgaacatctaatttgtatccagtattcat

SEQ ID NO: 9545 - DNA, 1525 bp, artificial
  synthetic oligonucleotide
atggcctgaagtttagcatttcactcaaagattgaaggctacatttaaaaactaatcgatcactcttcttcctacaacacatttattatttagcccaagaaataagttttgtgtttcagggaggtgaaaaggtgtaatgtatgcttaataatgtcttttactttcatgaaagtcataatgtcaaccttggagagaagagagggacccaactccaaagggttaccttagcacccgtaaagaaacattcattcagtccatcatcacagtcataaagtggaatgtgatgatgtagaggggtaggggaaaaaaactcatgtagatatcatttgggggatagaaagtaataatgctaaaagtagaactatagaacaattctttagaaatttgctatggatactcttcccacataaactatctccgttataaaaacaaggctttgaagaaccttttaaaatgtcccattaaaaatccaacacaggattgtaacaaatgtacctctctggtactggatgttgatagtgggggaggttgtacatgtgtgggaacaagaggtgtatgggaactctctgtactttccactcaatttttctgtaaacctaatactgctctaaaaactaaagtctattaaaaaaaacaaaaaaagaaaacaaaaaaaaaactaccatactaaactaaacccgtagagacagaaagcagattggtggttgccaggggcttacaggagatagaaatgaagagtggttgcttaatgggtatggggttttattttggggtcatgaacatgttttggaactagatcgagctggtggctgcacaacattgcactacatgccactggattgttcatgctaaaatcattaatttcatgtgatgtgaatttcacctcaatttttaaaaagccaccatacaatagatgagcttcttcaaaaatacattgcaaagaattatagtctcccaacgtggtcctgaaaaaaggacttttgcgatccaatttgttttgaagcagcgcccatgtatcttcttggtgatgccttcttggcattagcaaatatacagagcaaaagctctgaggggctgtgatggttaattttatggtcagcttgactggggctgtggtagtgcccagattaaacattgtttctgggtgtgtctatgaagaggtttcaggatgagattagtatttgaattggtgaactcattaaagtagatggccctctcctatgtgcatgggcattacccaatcccccgagggcctgaaaagaacacacagctgaaggaggaacccacccctttcctgtcacattgcaagatctgggacatctcatctcctcttttcttgctctcagacagggatttacatcattggctcccctagttctcagacctttggacttactggaattaaaccactggctttcctgggtctccatcttacagacagcagattatgggacatctcagcctccataattgcaggagtcaattccttataataaatctccttgtgtgtgtgtgtgtgtgtgtg

SEQ ID NO: 9546 - DNA, 2924 bp, artificial
  synthetic oligonucleotide
gaatacctttatagcagcatgcacttggattatctactgtacatctaagaccccgctaaggtttgcggttggagtcagtatgagactgacatgccacatccacacccaggaacctcctcagagctgagagaaatctgaggaaaacccgcagccactaaccttaacctggttgggaggggaagagacattacatcacaaataggggaatagttttctggggatccatccactcacaatcctcaggattataaactgtttatgagcttcatacttgtgaaataaatgccttcaattttgtcaaacttagcgtaactgatttccattaatctctattttcctgggcccagggcaagaggtgaaaggctaggcactagttctgtgctgaaccttgagtctgtgcaaaatgacctcaagctccatttttccatttcctctggcctcccctccccactcccacccctctttccctttcctcaaacctaaagagcaagcctacaaccctgatactgtcagaggcatttgaaccacagcaactccatgttgaataggggctgggtaaaataaggctaaaacctactaggctgcattcccagacggttaggcattctaagtcacaggatgagataggaggtcagcacaagatacaggtcataaagaccttgctgataaaacagattgcagtaaagaagccagctaaaacccaccaaaaccaagatggtcatgagagtgacctctggtcgtcctcactgctacattcccaccagcgccatgacaatacacaaatgccacagtaacatcaagaagttaccctatgttgtctaaaaaggggaggcatgaataatctacccgttgtttagcatatcatcaagaaataaccataaaaatgggcaaccagcagccctagggttgttctgtctgtgaagtagccattcttttattcctttactttcttttttaaaaaatgttttatttccataggttattggggaacaggtggtgtttggttacatgagtaagttctttagtggtgatttgtgagattgtggtgcacccatcacctgagctacacactccacccaatttgcagtcttttatccctcaccctcttcccaccctttcccccggagtccccaaagttcactgtgtcattctatgcctttgtatccttatagcttagttcccacttataagtgagaacatacaatgtttggttttccatttccaagttacttcacttagagtaatagtctccaatctcatcctggtcgctgcaaatgccattaattcattctttttatggctgagtagtattccatcgtataggtataccacaatttctttatccagttgtcaattgatgggcatttgggttggttccacatttttgcaattgcgaattgtgctgctgtaaacatgtgtgtgcaagtatctttcttgtataatgacttcttttcttctgggtagatacccagtagtgggattgctggatcaaatggtagttctaattttagttatttagggaatctccacactgttttccatagtggctgtactagtttacattcccaccagcagtgtagaagaagtgttccctgttcactgcatccactccaacatccattatttttttaattttttgattatggccattcttgcaggagtaaggtcgtattgtattgtggttttgatttgcatttccctgatcattagtgatgttgggcattttttcatatgtttgttggctatttgtgtatcttcttttgagaattgtctattcatgtcctttgcctaatttttgatgggattatttggttttttcttgttaatttgtttgagttcgttgtagattctggatattagtcctttgtcagatatatagattgtgaagattttctcccactctgtgggttgtctgttgactctgctgactgttccttttgccatgcaaaatctctttagtttgattaagtcccagctatttatctttgttttatttcatttgcttttgggttcttgatcataaaatccttgcctaagacaatatctagaaggggttttccaatgttatcttctaggatttttatagtttcaggtcttagatttaagtacttgattcctcttgagttgatattttgtataaggtgagagatgaggatccaatttcattctcctacatgtggcttgccaattatcccagcaccatttgttgattagggtgtccttcccccattttatgtttttgtttattttatcgaaaatcagttgtctgtaagtatttggtcttatttctgggttcgctgttctgttccattggtctacctgcctatttttataccagtaccatgctgttttggtgactatggccttatggtatagcttgaaatcaggcactttactctatggacttgccctaaattctttcttgcgtaagatccaagaaccctctcttggggtctggatctggacccctttcaggtaacaatacctctctggtaatgactctcctggatagagaactgcattactactccatgcccacattcagcaacaaacttctgagcataacatggatttgccttcataaaactaaggtaacaggatgatcttagcaagttttgatatctggattcctttctctgccatttcactttggtgatgaaccctcctgttcttcagagaccggattctcttactatttggtggtggattggcacactggtggtccctgaatttccctatacttatgccttcatgtagttccctcccgaaatgattctgagtttgaccaggcactatgtgaccagctttggccaataggacattagcaagcatgatgcaagcagagacctagtaaatgcttgcacactgggacatgtcctcttagagaactcaatggaagtctcttgccgtggtataaggaagct

SEQ ID NO: 9547 - DNA, 2381 bp, artificial
  synthetic oligonucleotide
attgattttgaagtgttaaaccagtcttgcattcctgaaatgaatcctatgtggccatgatgtattgtcgtttttacatattgctgcatttcatttgtaatattttttctttttcttttctttttttttttttttgagacagagtctcactctgtcacccaggctggggtgcagtggcacaatctcagctcactgcagcctctgcctcccaggttcaagcgattctcttgcctcagcctcccaagtagctgggattacaggcgtccaccaccacgcccagctaatttttgtatttttagtagagacggggttcaccatgttggccaggctggtctcaaactcctgacctcaggtgatccacccaccttgacctcccaaagtgttgggattacaggcgtgagccacctcgcccggcctttccaggattttgaagtctatgttcatagagatattagcgtttaattttccttttgtaatgaccttgttaggcttggatattaatgttataatggtctcataaaatgagtttgggagtttttctgctcttcctattctttggatactataaataagaatggcattatttgtttttaaatgtttggaagaattcaccattaaagccatctgtgcctagagttttctttatgggagacttcaaattgtacatttgatttatttaatagatataagaatcttcaggccaggcgcagtggctcacgcctgtaatcccagcacattgggaggccaaggcgggtggatcacgaggtcaggagttcgagactagcctgaccaacatagtgaaaccccgtctctactaaaaatacaaaaattagccgggcatggtggcggcgcctgatatcccagctactcaggaggctgaggcaggagaattgcttgaacctgggaggcggaggttgcagtgagccaagattgcgccactgcactccagcctgggcaacagagcaagactctgcctcaaaaaaaaaaaaaaaggaagaaagaaaaaaagaatctttagatctttagattttactcagattttgcatttcttgggtacattttagtaaattgttttttgaaaaatttacgcaattcatgcaaattttcatatcctgcccttcctgttctaactgtatctaaaagtaaccaaatagatgatgaggaaatgttctttttttctaaaataaattcatgtttataaattattcgttctagccaggcatgacagttcatgcctgtaatcccagcactttgggaggctgaggcaggagggtcgcttgagcccaggagttcaaaagcagcctgggcaacatagtgagaccccatctctaaaatatatctatatatctctgtatacatatagaaataaattattcattcacaaacaaataactaacctagaacactgttattctgtaaccccaaatgaaatagatctagctgggtacggtggctcacaccagtaatcccaacactttaggaggcggaggtgggaggattgtttgagtccaggagttcaagatcaccccggggaaggtagagagacttcatctctacaaaaaatacaaaaattagccagtcatggtggtacatgcctgtagtcctagctgctcaggaagctcaggcgggaggatagcttgagaccatgaggttgaggaggatcacttgagcccaggaggtttaagctatagtgagccaagatcatgttactgcactccagcccgggtgacagagtgagaccctatctccaaaaatataaaaaatagaataaaataaataagagatctaggcagtgataattaaggtgctcaaaacatgaagtgataaactgatgggaaattttataatggctgacaccacctgaatctactgatcaatcttaacatctcctaaagagaaataaccacagtatgtgttgcttcttgtgacgcatacagtacgaagtacataccactatctatgcaatgttcttgacagaaaaatcaaacctgaatctgattatgtatgtagaattacccagcagtttacaggtaatacaggggacaaaagaacatgttaaataacaccacaaggatacaatcagcaacatccaaaatataggaagttctataagaaaatgacccagttttgtcagcaaataaaatgtatgggatggaggaagggaaatgggtccaataaattaaaagagaattaacaagcttcacagaaatcaaatataatgtgtggacactgttcagatattgattcgaaagaactgttacagaaagaaaaaatttgagataattggaaaaatttgaatgctgagaggatatttgattttatggatttattgttaatttttttggcgtgatgacagtaatagtttttttttaagagttctt

SEQ ID NO: 9548 - DNA, 1672 bp, artificial
  synthetic oligonucleotide
ttttcccagcggtggaaagagagtgtgttattgggcaagtccattgcacattttcttcactaaataacaaggaaaattgcctccatcagtgtgttaaaaaaaaaaaaaaaaaaaaggaaaagtagagacaagtgggatctgaaagtgacctgcttccaaactcaaggggagaaaacgttatctatccaggaaaagctccatagcggaattttaaaacatccaacatccctcagactaacaggtgtcacagaatatgaagaataaataaatgaatctatttaacacgggtcatgcttgtctttgaaaatagtgtctgaggccgggcgcggtggctcatgcctgttatccctgcactttgggaggccgaggtgggtgggtcacctgaggtcgagagtttgagaccagcctggccaacatggtgaaacctcgtctctactaaaaatacaaaaaattagctgggcatggtggcgcgagcctgtaatcccagctactcatgagactgaggcaggagaatggcttgaacctgggaggcggaggttgtggtgaaccaagatcgcgccactgcactccagcctgggcaacaagagcaaaactccgtctcaaaaaaaataaaaataaaaaaaagaaaagaaaatagtgtctgaaattattttgttaattgtacttagttttaaagtttaagaagtgtatacttatgaaataagtagactccaatactagtttagggcctccacattactacatagattacaaagcttctccgttagcccagctgagctgcccccaacaaacagttttcatatttatttagtattcgtgttctattttcttccagatagctttgtggggactgacaatttaagtaatgcaaaataatttgattatgacaactgagaaaagaaacgtgtgttgtgttttgaggttatcatttccttgaccatcataagcagcctggtatctatttcatctttgttcgtaatcacagcacacctttgaacacataccaaaatgatgatggaatgagagcaaagtatgtgagtcaattggctactctgtgaaacaatttgttagttttaggctatagttcttttcaattttcagccaaattctataaaaatcttagctggaaggaaatgcaaatgtcaggttacattttagaaattaatttttgggctgagtgctgtggctcgtgcatgtaatcccagcactttgggaggccgaggccggtggatcacctgaggtcaggagtttgagaccagcctggccaacatggtgaaatcctgtctctactaaaaatacaagaattcgccaggtgtggtggtgcgttcctgtaatcccagctactcggtaggctaaggcacaagaatcacttgaacccaggaagcagaggcctgggactctccagcctgggtgacagagcaaaactgtctcaatttttggcccaattaccatgtagcattaacttgtttcagaatgtttaatattactgggaagacagcatcggtagtggtcaaagtgatttgtagttcacaaagcatgtaggcatttttttttgaagaaagtaaacaaaataatttgaactgttgtttcaggtaataaaatagactcatgcggtaagtcatttgagctgtatgtacaaatggactatgacacagctaaattagtcacaact

SEQ ID NO: 9549 - DNA, 1891 bp, artificial
  synthetic oligonucleotide
aattattcaggaacctagtctttgaatgggtagaggatagggagtagaaatcaaagacatcaacattactctgaaatataattagataattgaaatcctatgtaaactgctttttttatcttcagttgaacatcctttataattgcatttttaaggttttagaagacatagaataatttttttttctttttactatttgtataggcaagtcccattaaggcgcactctatctaggtgccttaataatgaaacaagtttacatcctaacacacacatttttagagaaaaaagctaatcacacagtgcatagaaaaagtagatgtgatccagaaagtgggagctaaatcatactcttttcccattgccaccagttaaataggaactcaagaacttaccatcagtatagcaattgaacttaataatcagtgtagcaattgaacttaatatgttaaaccagtttaaaacgtttggcttttgtattttgtcttttgtggggggaggggagaggggagagggttgggcagggtctcccccaggctggagtgcactggcacaaacacaactcactgcagcctcgacctccttggctcaagccattctcctacctcagcctccagagtagctgggaccacagatacacgccgccacacctggctaatttttgtatttttcgtagtgatggggtttcgttacgttgcccaatcctggtcttgaactcctgagctcaagtgttcctctcgacctcccaaagcgctgggattacagaggcttttgtattttgaaataaggtctaagtaactttcccaaagtagtaaattgacaggttcttcaaaatactagtaattggtcaagtgaaatttaaggtcatataatattacgagtttaactcaaatgaagtgtctgcttctcaaagagaacctggttatgaattttaagttgttgtatggatttatatatatataaatagtctcactctgtcaccaggctggagtgcagtggcgcaatctcggctcactgcaacctccaccacccaggtttaagtaattatcctgccccagcctcctgagtagctggggctacaggcggatgccaccatgctcagctaatttttgtgtttttagtagagatggggtttcaccatgttgcccaggatggtctcaatctcttgacctcctgatccgcccgccttggcctcccaaagtcctaggattacaggcgtgaaccaccgtgcctggccgtatggatttttatttagccaatattaatttagcatcccctggaaaccaaatatgaataagatattatccctgccttctctccgtacacacatctaagatggaagatttgtgtaagtatgttatgcagaacctggaagaggtaaaagatgggtattttgggggtttgcattgcagcaggggttacatcatcacaccttacagagcaagatctgggaacttctagtagtttggcccaaagggtggtgtgttaaaagaaactggaaaggtaggaaggacccaaaatttctaagtttccttggctgagagatgtttagacttcaccctgtagttaatatggaaccagccactggatttaagccaaagaagaccattgaatttgcagtagtcttcctacctgttttaacagattccatctatcctctacattgctgccaggatagttctaaagcatagaaattcaggggaacagatgatttaggcttgaacttcggatatggtgaagattaagagcacaaatttgaaagaagtaaagtccacaaactcattagatgtttttcacatgtgtgagggtgcttctaactggaataggaaatagagaagtggagttctggaggcagaagataatgaacttcctgtaggacatctaatttgct

SEQ ID NO: 9550 - DNA, 681 bp, artificial
  synthetic oligonucleotide
tcctccaagaccattcagccagaggatgtgcgctgatatccagggaatattgccttgtgtgatactgtggaggcattcttagctgcttaaatttccttttccactaatagtcatttcatctttgactccaatgttagatgtgtgtgaaaataatacagccaccagtcagcctattttttctttttcagcaccaatatagtcatgttctttgttaaaacaaacaaacaaacaagcaaatggaaattttttgaagcatccttgacctagtagcctgtgaggcattaaaatatttacagtctgaaaaccagctgtgaatccaacataaaattttcattttcattaaaacactttatcacagggtgtcttgtatcagaacgaatcgaatatggtctatctccctcactggggtgtcatctcccagagtgcaaagaccttgtcttgatacccttatgccctcctagcgcctagcacaggtcctataaccatcccttacatatttttgagttacatttaaacaaaagtgaatttcacttgtttactagttcatcggaacccacatttagattatataatgaacatgcattttggttaatttgctgatttcccttattctatgcattttaaaaaataatggaaacataggaagtaaaatagccaatcatcctcgtttaaacaaagctg

SEQ ID NO: 9551 - DNA, 416 bp, artificial
  synthetic oligonucleotide
tagatgtatatgcactttttaatattatatatataaataattttacaactttagaatataatatacattttgtttttatctttctttgttttcatacttccatcaaaatttgctattgattactcatggatacaggaataatatacttttaaaattaaaaacattatagataagatcaaaatcccctttgaccactccctctccgaatcctggcccctgtcctctgccttccctccccaggagccaccaaagtcaccactattgtcaatttgactggcatcctttcaaacagatggcgtacatttatgtcacaattggaattttgtgtgtaagtctatatgtgtgtatccttttacaatttttattgttatataagctcaaagaaaagttgtggaatgtaaatgttcaacatgatg

SEQ ID NO: 9552 - DNA, 272 bp, artificial
  synthetic oligonucleotide
atccctgatatctgggcctgaaatctgactccaagatgttttatctgtgttatctttggcaaattacttaatctctttggtctctgtttcttcatttgtagaaagggaataataatgataaccaattttaacattgttgtagggattaaatgagatatcgtattggaagagcttagcatagtgcccattataaagttcaatgactgctatgattatgattacgagtatgatttttacaatgcaaatgttagttttgatggcttttcaaatgt

SEQ ID NO: 9553 - DNA, 962 bp, artificial
  synthetic oligonucleotide
aatgatcaagagtgcaattgctgggtgatatgataactgtatgtttagttttataagaaactgtcagagtgctatgccaacagcaatgtatgaaagattcagttgccccacatcctcaccgccatttggtataaataatatttttattttagccattctaattggtatataatggtatcttatggtgattttaatttgtcaaatactttgtatgattttcaattcatagcattgtgtgacttttccttcctaaatctgttaatataatggataacctcaatggattggggggaggaataacttttttaaaaatagattttagtttttagagcagttttaagtttacagcaaaattgagcagaaagtgcagagttcccatatattccctcacctccacacttgcatggcctcccccactatcaacatcccccactagttacaatcgatgaacctacattgacacatcattaccatccaaagtccagtttcattagggttcactcttggttttgtatacgccatatattttgacaaatgtataatgacatgtatccactagtatagtatagtataggtgtagtatagtatggtatagcataacatagctttgtatatacagaatagtttcattgccctaaatatcttctgtgctttgcctatttattgctccctttccccaaaccctggcaaccactgatctttttactgtctctatagttttgccttttccagaatgtcatatagttgaaaccatacagtatatagcagacacctcaccaaagaaggtatgcatttggcaaaggaaccatacaaaaaggttcttgacatcatatgtcactacaaaatttcaaattaagacagcaaagagataccactatatacctattgaaatagtgaaaaccccaaacactgacaacactaactgctggtgaggatgtggagcaacaggaactctcattcat

SEQ ID NO: 9554 - DNA, 1951 bp, artificial
  synthetic oligonucleotide
agtgggctgaatggtggtcctcagatgatatgtccatgtcctaattttcagaatctgtgaatgttatcttatttgaaaaagggatttttgcagatataattaaattaaggatcttgagatgtgaagctcatccttgattatctgagtaggctctaaatccaatgacaagtagccttataagcaacacaaagaggaggaagacagaaaagacggcattgtgaccacagaaccggagattggaatgatgcagccacaaaccaaggaatgcctggagccaccagaagctggaagaggcaaggaacagattctccactagagacttctgagagagtgtggacctgacaagaacttgatgtcagacttctggcctccagaactgtgagacaataaatttatgttgctttaagccaccaagtatgtggtaatttatccacttaagtccaataccttatgcctgggttatgtggcattctactgactctggccagaccagatatttctctggccagcccacagcataattgtgtggcaagctggaatgctaggctgtcaatggaaatctctgaatgtctacaatatgtctctctctagtgcaggagatcacagggtcatgaaacttaagagatgatagggatcttgaagagcatgtggtttgacctctcccctaggcaggaattctgttttccagagttactagtagttggccaatcagcctctttttgaacacttccccaatgagtagtgtacccctctcataccatatccctcttcatttatggacaactttcactggagagttcttgatatcgctgagccctaattttcccattacattttccatccagttaccaaaattctatcttgaagacccataaaagtaagtcctaattcttctttcatattaacaatttctcaagttattgaaaatacctgttatgttcctcaactatctagcaactagccccgttccacttaccattactcaggtgaagtcatttttaaacctctcatcatataatattcttctcatttattcatacaatttaaaatatggcactgaaggctgggcatggtggctcatgcctgtaatcccagaactttgggaagccaagtcaggaggattacttgagcccaggagtttcagactagcctgggaaatatagtgagaccttgcctctacaaaaaattttaaaaattagccaggcatagtggcatgcatctgtagtccctgctatttgggaggctaaggtgggaggatcgcttgaacccaggaggttgaggctgcagtgagctatgatcacattactgcactccagcctgggcaacagagcaagatcctgtctcaaaaacatatatgtagagagcattgagaacagaacacaatctacacataactcaagcaggggagagtgggaccattaccttccttattttaggtttaattcgtgcatcctaagactgcattcacattacagataatggtgtcatatgattgactcattcccaccttcctggcagctgaaatctaagagttttacagaatttctgttaaacctaattgattttggaatctataggaagtgtttttttattcacttctggaattgcctcttgtttgtttcagctaatttttccaggctgtcacaatacttttaatgctaatttatcatctggtatattagcttgctttggctgactctcattcccatgctcctcatacctggaacctaacactctgtctccaggctctggtttaaacccttccttgctggactcttagaacatgctcacacactcctattataagccatttctccttacctttgactcttctcaaatcataacaaccaatttctgggccagggctccaatctctaaaatatcttcctgctctgatcttctttcattctattatgtcagaaactcacaagtactcaaacctattgaaaca

SEQ ID NO: 9555 - DNA, 1065 bp, artificial
  synthetic oligonucleotide
aatagttctgacttaggaataaacagaagggtctatgattgtttcaggtgagacagagagtagcaaacattttcattctccccagattctgggcaagtggaaacagttgtaaccaagaagtttagcagcttaaaattttaatttttccttgtcagacatctagcagctgaaaaaaaggacaaaactagctacttggtaactgcagctggctggtaaactgagggtttgagttctaaatatgcacccaaagatgaatatttcattgctccctatgaacagggccccataatattaagaagagttgggatccggattaagagtgaattgaattcttaatccttgtgctcacacctgtaattcccagcactttgggaggccagggtgggcagatcacctgaggtcaagagtttgagaccagcctggccaacatagtgaaaccccgtctctgctaaaaatacaaaaattagccaggtgtggtggcaggcacctgtaatcccaactactcgggaggctgaggccagagaattgcttgaacccaggaggtagaggctgcagtgagccaagatcgcacccctgcactccagcctgggcgacagagagagactctgtctcaaaaaaaaaaaaaagagtgaattaaattcttaatcctctatttaagattctggggacttaagagtttgaggaaacatcacagtaagaattcatagacacatttatgttttaaacacaaccaaaaatattgagaaatggtaggaaattagctgatagtttacttagggtgtacttgggagctacaggtctcatgaaggtgtaagtcagaaccggaagatatataagcatccttgacatagttcagggacattcaggaactagaggccaacacgggggaataggaacccattgcagaaagaaagggccttgtgaggttgccctgcctgaattagcggtacttcatttaagttcttcaaataccccagcagcagccagcaatagttctttcagagcacacatctctccttccctcaccttgtactgccagcgattcaataaaaaatatgaacctgc

SEQ ID NO: 9556 - DNA, 437 bp, artificial
  synthetic oligonucleotide
attctcatttgacaatcagaactatttaacaaaaacagacaaaaatctcccaacactctgatcaaacaagggccaggaatactttacctaaaatttttttaaaaggcaggagagccccagcatgtcagctgagcaacatcagaaaaaaacagggtgcaggaagaagaacccagcctagatcaggcagctaccatgaagcatgaccagacaaagggctgcaggcgtcctctggtctgcatcccagacacagggccttcccagtgcttgcccctatctgagtcagtgaagaaggtgttaaggaatgcctgctgcccctaagccacctgctcaggagagaatccttcaagggcttgccatgctgacaggcaccgaatgagggtgctgcctgtacataagatggacacattatgtttgcctcttaaataaccgcctttttg

SEQ ID NO: 9557 - DNA, 399 bp, artificial
  synthetic oligonucleotide
agtatgatgaaggaatataatcatgagagcaacgtgtggtttaaaaatcccacgggttcattaaagaaaccagctcccattggtctggtgccagttttccttttgtggctgaggctgttgggaggagagctgaacaagtggacatggtgaggtttaattctagacagccatccatcagctacaatatttaaatgtctatgttaataagcctttgttacggaggagaacaggtacgtgggtgcactgttctttagtgagacctcattttttcttatgtaaggtactgagggtaggtgatcacctgatcagtgtggccaccactgtggagttttttacagcacagtaggggttgttatgagttttaaagcttcatctgaaattccaagaaaagaaagtatc

SEQ ID NO: 9558 - DNA, 4136 bp, artificial
  synthetic oligonucleotide
caaaaaagactcaggaagcacaaaaataggcaagactaaacaatacattattaagggctatatacacgttacaaacctaaaaaagactatttgctgctatccatagcaaagaatttgttgctagcagatctgccttacaagaaatactaaaggaagtcttttaggtaaaaggaaatgatactagacaatgactcaaagccacacaaagaaattaagagcactggaaaatgtaaaaatatgagtaactataaaacactatatacatgtatacctttttctcttctctaaactcttaaaaagacataaaactgaattaaacaataattacaatgctgtattgttagggttgtagcttatatagatgatacatattttatgatactagcatgatggagggatgtggtaatggagttagaatcaaagaaagtttcaatattttactggaattaaattagcatcacactaaagtagattaagttaagatgactattgtaatccctagagcaaccactatgaaactaactcaaaaatatagtggaaaaaacacaaaggaattaaaatggtaaactagtactatctctcccacacacatggagggcagtgaaaaaaaaacaaagaatcaaaactttcatgaaatatatagaaaataatagcaaaattgcagatataaatccaaccatacgaatacttacattaaaggggactggactaaacactgcaatcaaaaggcagcaattgtcacactggggaaaaaaccaagattccactttatgctatctaaaagaggcacattttagatcagggcttctcaaccttagcaccactgaaatttcaggctggataattctttgttgtaagagctcttctgtgcatcataggatatttagtagtagccctggcctttattcattagatgtcagtagctgccatgcaggtatgacaaccaaaaatatttccagctactgtcacatgtcacaagggggctaaattgcccagttgagaaccattgttgtagattaaaacacacacacacacacacactcacacacatacgtttaaagtaaaaggactggaaaacatatgccaggtaacaccaatcataaaagcactacagtaactacatttatatcagatgaaataaactctagacaataaatattatagacggaaagacccttcatcataatgtcatcaggaagatataaaaattattaaagtggacacatctaaaaacagaataccaaatcactgaagcaaaaatgaacagacattaacatttcaatctttgtttttctgggaatgtcattatttcacactcattttttaatgtaaatgttcattacttttgttcctttaagtgctgacaggtctatgatgttccctgtgctggcagggacctgatgagttattaaggatctggaagccttcaggtggctgagactcttctacaagaaatggccaaactggccacagtcatttttttttttgcatcaccacacttattgtttttttaaatcaattttattgagttataattcacatcccacaaaattcactcaatttaagcatacgattcaatgatttttagtaaatttaacaagttatgcaaccatcaacacaatcactccaataagatccctggtatccatgaacagtaaataccagttttccacctccagccctcggcaaccattaacctactttgtttctatatatttgccctttctaaacatttcatataaatgaaaccgcacagtggctgatcttctgtgcatgacttctttcatttagcataatgtatctatgtctttatatttaaagtgggctttttcttgtagacagcttataaattgtgtctgctttttttaatccaatctgatgatctctgtcttttagatgattcacattttcacatttaaagcaactatttatatggagggtcaaaatttactatcttgttagttgttttctatttgatcaatttgttccttttttcctcttttttctgctttctctgggttttattgagcattttttattattcaatttatcacctctattgacttattatttatacctctttttaaactttttaaatagttatcctagggtttacaatgtttttaaataatctgagttcaaataatatagccacttcacaaggagcataggaccttataacagtattttaccaattcctcccttccatctttgtgccattgttgtcatacatttcacttttacatatgctataaacacacaacacattgttataaattttattttttaaaaatcacttatttttagaacaactaaatgtttaaaagatttcatcttcacttacttcatttctgacattctttgattctttttgtagatccagttttccaaattatatcacttttttctgcctgaagaatttcctttaacgtttcttgtagagtgggtctgctggcaataaattccctcagtttttgtttgtctcaaaaagtcttttttcttcttcatttgtgaaggacattttcactggatatagaattctgggttgacaatttcttctgtcaacacttgaaacaagccaccccactgtcttcttgcttgtatggtcttttactgaaaagtctgctgtatttcttatccttttcctctgtatatagcacttcctcctctactcctccccctgccctctccccgcacccagacaccttgtctttagttttaagcagttcaaatgtgatatgcctgggtatctgtttattgttttggtatttatcttgcttggtgttctctaaagttcttggatctgtggtttggcatctgtcactaattttggaaaactctcagctattacttcttctaatatttctgtcccattctcattctctctcttcctcccaagattccaattatgtgaatgttagaccatttgacattgttactcttctcttggatattctgttctgatcatttcaccctttgccttccaatatctttaagttcattgactcttacagtccacagtccacttcatttgttactgtattttttgtttctagcatttgaatttgattttttcttttattttccatctctgtcctaaaattacttatctgatcttgcatgttatctactttttccattagagcttcaaaaatattaatcatagtttaaaaaaaaattctctgatagttccaacatctgtgtcatacatgagcctggttctggtgactgctttgtctcttgccttttcttgcctttttggtcttgtaatgtatttctgatggtcagatattttgtatcaaaatggtactgaggtaaatattttttatacttgaagatgagtacacctttttttctgataggcctttagcattgaggtttgtattaatgtaatcaggaggtgggctaggtttgaagattattgtttccatggttatgctcagggcctcaggagccttcatattcctgtactgatagcttgtttttatggcattgggtaatttgccacaagatttttctcaatgtcttcccctcgcttggctttgggtctccatacttgacttttaagtttttgtactgctccccagagacaatctctctcttgcagctccccaggccttattccattgttatttttatttgatgcttgttagctttatagtaaggaggtgagaaatgggggtattctgatattctgattaatttgcaatattatgcagatactgtgaacctgggtcttggggttgtggccttcataagcattcctgatcctcctccaaacacaatgccaggcctaccaggcattcatttcctttcccaagaaagtagatcttctttctttttcctcttctccttccccaattacagtgggtttccaccagtagtctcactttctgttactttcttcctgcagattaagacttttgttccttagggagatggagagatatctaggcagattttggcagtggcttttgttcttctaccccagccaagacacaggaaaaactttctcaggattctccctgatcttccctgtgagtatttggcaggaatcctggaggaaaagcctgtaagagggcaagaaatccctatatctgtggcccccaactttgagcaattcattacaaatttct

SEQ ID NO: 9559 - DNA, 1543 bp, artificial
  synthetic oligonucleotide
cttattttttgatagacaaaatagaatgcactaaacaaacacttctggagcatctactaggtgtcaggcactgttctagggtctggggagacagcacaaacaaaagatagatatctctgtctgcccagggcttacattctaatgcattttggaaaagctctccagaagattctgatatgcccatcacaactagcatagagtggagagacatgagagctgcacagacccaaccctatccgcctccccacctctctgatagtgaggtctagagatgagaatgctttcaagcaactactctcatgtacgaaggcctggtgctgccactctgaacagctcttaacattttttcccctaaaacactggtagccttctgtcatatcaatggaataacacctggagtgtgacctttgggctgaaaggagcaggcattttgctcctacttggatccaaggcccccaggctgatctagcacaggaaaactaagttttccttgtcatcctgcctcattcctcactgttctacactggagcttgagagcaaaagtcctagctaacataaaagagtcaactttgggtcaggcacagtagtcacacctgtaatcccagcactttgggaggccgaggtgggcagatcacttgaggtcaggagtttgagaccagcctggccaacatcgtgaaaccccgtctctactaaaagtacaaaaattagccaggcgtggtggagcatgcctgtaatcccagctagtcgggaggctgaggtaggagaatcgcttgaacccaggaggcggaggttgcaatgagcagagaccgtgccactacactccagcctgggggacagagcaagactctgtctcaaaaagaaaaaagaaaaaaaaagggtcaactttgctttgttttctactctgggcatagatttccctcagagacctcctaggaagtggtaatgggcgggattcaggttctgctctatcctggccaaatacatcctcagctatattgagttcatcctttaatagatcccaatttcccaatttcaaacatgtgaccttaaacaaaggaggtacttgacctaggtttcaatttctttacctgggaaaatgggaccaatattaggatcttcaaacatttttattttttggagacagggtctcactctgttgcccaaactggagtgcattgctgcaatgacagctcactgcagccttgacctcccaggctcaagcaatcctccatcagcctcagcctcccaagtagctgagactacagggacatgccaccatgcccagctaatttttatatttttaatagagacagggttttgccacgttgcccaggctggtcttcaactcctgggctcaagcaatcctcccgcttcggcctcccaaagtgctagaattacaggcatgagccaccacacccagcctgatcttcatacatttgatgtgaaggttaaatggcttaacgtatgcaaagtacttaacacggtgacagactattctaacaggtgctcaataaacagttactatttttttctactattattt

SEQ ID NO: 9560 - DNA, 2650 bp, artificial
  synthetic oligonucleotide
cacattaaaggttaaggtttctgctttccattctctatcagggcacctggatggaaactgaataaagaaatccctcagtatatgtgataaaataaaattttccccgttgggaacaatcatgaagtggctcgtctatttcgtgtgaggatgccaattcaggggctttaacaccactgaattacattcaaaaagagaatacctgactccactttggagtcatgggcagggcgaggggggaggcagggggcacagaagaggaagagggatgactcagattatggctgacatccatgtaataaagggagatttgtactgaccactgtgcatgtaacacactgtgtaccattaaatctagaaaaggatggtagcatcagcccacccctaacaacaaaagatggctgactccggaattaaaaccacgacttttccccttcatacattcggaaatgtatctcaaactcactccctgttaccgtcttaggaatacaaaagctcctcttcgtttgagaaagcaagtaactgggtataactttccactcgggacataagagcaggaggcgtgcctgtctcctcgtccaggcctgacatggtggtgccacccactctgggtcctggaccactgctcacctttcaccacacttcatgctctgactttatcattaagagacctgggaatgtggacctcaggagtgggtacccacccaggctgaccatggatgtggcgtccaagaggccccactaacccatacccaagcaaagacactttcagacttcgtccccactccctactgtggcctgtcccctgaggtgatgcagtcacctgggaagccacccacctccagccaccacgcaggcacacacaccctatcgagctcaactggagcgggaggtggtgggtaagaggtttgcaacagagaccgaacggggcagacggaaccggaccacctctgtccctttcattttcctgggttcccaatgcagaaacgtggaataggggtggaattgtttttaacggtagcagagagccagaaaatgcagacagttgaccttgggaaccaacaccgtcgcagcgggaaacgtaaaagaaacggaacacgttggcaagtgaagggggagcaccgcgcggcgccaggaggagcgcggcggccgaggggtgtggagggcggggggtgtaacaggggtgctcaccatagatcatggccagcccggtctcgtgcagaaagcgcacccggcggtgcttgaagagccagatggtgaggatggtgagcgtgagcagcaggatgaaggtgagcaggctcacgctgtcttgccggtggctctcctccgcctccttctcagtagcgagctcctccatggcgctgctgtcctccgccgccgccccagaggaggaggccgaggccgcggccgcgactcgcagcccccaacccagcagcagcggcagcagcagcagccgcggcggcggcgccccggtagcccgacccgagccagggcgcgccgcgtcaccaggctccatggtcccggggccccccgcgcctcctccgagcggggaccagcagcccgcgccgtcggcgggttctggcagcaccgcggacctgccggagtggccgtggccgctgcagctcctcctcctactcgcgccgggccggggctgcgcccggggccgcgcgggggaggggcgcgcgcagtgcgcaggatccccaagcaccgccccccgcccgcgcacctgttcgtcccccggccgcgccacgccgcaccgccccgcgggccaaccgagccacccaggcggggccgggtgttgccctcgggtctgcgggccggccgccggctgcttgcctctctgcgcttctcaccccgtcctggcgcacctgcccaggcagtctggggtcgtggggccagttcatgggcagccgccgccgcacttccgaaaggggacgccagaggtcgccggcgcctagcgggagcatcggcttggagtgactagccttgcggtctcgagtcccgtctctggcgccacggcgaagtgtttaatctcaggccagtgtgcagccgccctgggcccagtaaagtgggggctgtcagtgaaccgagcagccccgaagccacgttagcccctacacctctctttcctcatctctcaggttgcccttccagccccagaatctgctaggtttcattcaaacctctgttctcatcagactcaaatgtgaggactgataaggagttggaatcgggggagggcattgaagtatctccttcctcacttgagggaatagacttcgtctgcgctgtgctactaatccccttggggaatagggttgaaccagaaggaactgaacgcttgccattcctggtagatgagcagtagctggtcctaaggtggtggtggggggtgggggttaccctgatgaccctttcttttatgttgctcacctggtagctcagagagtcttttaatgactcttaagaccaaacccagctctgaacaaaattatggcgtggactctgaaggatgaagcctcttggaacaaattctcaggaaaactagaatcttcaatccaccttgctcctctggtcaaggaagaaacaagatcagattaatcactgagttcccagtgcttagcactgtactcatgtgtttattgaaccactc

SEQ ID NO: 9561 - DNA, 1346 bp, artificial
  synthetic oligonucleotide
aaaaactggttgcacaacgtctttgcttagtttaagcaacccacaatccactttcccagaccagttctcctgttaaatactttccctttagccacttcttgtcagcctaggctgggagggggaaagagtagggctgagagaggagtcggtctgaacaaagcattgtgtttttatttagtttaatacttccaaaacatctgtagacaatgggagtatgggtcccggccttcgtaccctttgagtagtgtggttctcatgcttttgtagcatcatgtgattactcttcggatacgtaaaaatagattttttttcttttttgtttaacctaagagtattctacctccataacatatcattttctctttcgtttaaagtgagctctgagcttaaatacttgaactgtaaaaggataataccctctcttcaaggattacctgagaccgttgagaagtgtttcagtgcccagcgtgtattcaactttcaatcgatgttagccaccatctttgccaccttttctccagttgtgctcttctttatgcttttgtttgctagagaatagcttttaacccaatattgttgccttgctttctgtccagtcaattctggaatactcaggggtgcaagtctggctctagaattcacactttctctctcccctcttctctgagtcatgttgcttgccctcggcaatgcgatgtgaatctggtcataggtagaaaaaagtagagaaaggcttcccactcctccctgaagtgttgtgacccaccttcaggcccgtaggggagattcccaggagcaggacaggtgatggtgcagggctggcatcatagctaagaagtatggattggtgaaagttaaagaagaaagggtgttgaagacttgtaggtttagtattgtcctctcctttaataatgcttgtcttttccctctcttgtgttccaccaaccataacaacccattttttcccctaacctacacaaagccatatcttctttctgcccactgctttgaggtctggctggaactaggcaagtattttggaagaggtgggggaggtaggaggcatcaggtgctggtaaagacatggcattagggagggctcttacaagccttgatcagagttacagagagccagtccaaaaatgaagctgagcattatcaggggacataatgcacctacctccttgtggagcttacacaaaataggagctgagaagacagaggtaatatgctgtcttacattaagaaaatctctcattgaggtatgatttactatgatcttgacttgtcccacaatataggtgagaagtgagtgttaggtgacacctgtctggcactctcctaac

SEQ ID NO: 9562 - DNA, 1539 bp, artificial
  synthetic oligonucleotide
ctactaccctaggacattgcctgtgtgtttatctaagctctctcctggttgctgcccatgtgtgagtcccttgagggccaagattgtgcatcatttttctgtgaatttccctggcacaaagtagagagcctgcccattgttagtacttaattatggtttatcaaataaatacattcatgttttattgtaccatggattcatttgtgatatgcatttccccctctaaaaataatatatttttcatttttcagttattggtcattttatagtagcacattggatttatatccagtaacttattttctttattgtggtcactgtagtttcccccatttttgcttttgttgtgggacagggtctcactctgtcacctaggctggagtgcagtgacacaatcatagctcactgcagccttgaactcccgggctcaaatgatcctcccgagtagctgataccacaggtacacgccactacacctggctcatttaaaaaattttttttttgtagagacaggatttcgctgtgttgtccaggctggtctcgaactcctggcctcaagtgagcctcctgccttggccttccaatccaaagtgctgggattacaggcatgagcactgtgctcttttttttttttggtccgagtctctccttgttgcccaggcttgagtgcaatggcgcaatctcagctcactgcaacctctgcctcctgggttcaagtgattcccctgcctcagcctcccaagtagctgggattacaggcacacaccaccacacccagctaattttttgtatctttagtagagatgagatttcaccatgttggccaggctggtctcgaacctcaggtgatccactcgccttggcctcccaaagtgctgggattacaggcatgagccaccacacctggcctttttttttcttttctttctttttttcttttttttttaaagagagacagagccttgctttgtcacttaggctggagtgcagtggtgagatcatagctcactataaccttgaacttctgagctcaagcaatccttccacctcagtctcccaagtagctaggtctgtaggcacatgccaccatggctggctaatttttttgttttgtagagatagggtcttgctgtgttgcccaggcttatttttttctacaataattagtaattggcaataagactttggtgagagaaaatattggccttgaccttaacagacctggatttgtattacagccctgatgtaccacattctgccactattatggttatttatctatgagttttatctgccctagtagactgtaaacttagactttcatccttagatcccctatacccgaatctagtagacagacaattaatagattgatggatggatgatggatgaacagtttgagagatgaaacattctggtgtaagtttctcatttgcagagcaatgattcttactttcattacttgagttcagcttctttattttataaaggtcttaccaaattgagactcttacaattttgattataaggaatttcatt

SEQ ID NO: 9563 - DNA, 1422 bp, artificial
  synthetic oligonucleotide
cggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggtgaggctgggctgcggtggagcctcggcagagggaacggtgggggcattgacaaccgctggggattcggcggccgagggccgcgggaaagctgctgcggggtgcgggggcgggggagtggccggcgggacagcgggctaaaggggcggggaagtgcctttgaatgaatcgcaacgtctggaaaaggggcggggcctgtgtggtgcagtctgacgcctgagaacaaaatggggtttgttgtgatgagaccagtttcggtcctggaggtggggccgggcctgcgtagtgaaactgcgtaggaacctgggaagaaggtgggttctgctacataaggcgggggcgcggcctgcgctgcgtaatgcaacttttgggggcgaggagcggtttccgattgctccggggcggctgggaacgaggcgagctttgtgacgtcagcagaagagcgggatggagccgaacggtccgagggagggagcggggacctccgtgggggaggggggaggagcctggagcctgggaacgaggttaggttggtgacgtgagctgaggggcgtgctctgaggccgagggacgacagtggaggggaggtggtgcctatgaggcagaaaatggcgcctgcgaataagcaaagtttatgacgcgccgtggtttttgattctggcggaagccttcccgagtcgagagaacgtgcaggtgattagcaccggaggggccttccatgtttaattggttttctgtgttggtactgttttgtttttagaatcaagaaaaagtcgtttttttaaaaaatagaattttgataaatcggcttgttttactgatttcttgctaaacagtccttcttgaaatttactgcttctgagttcattttatttctcgccgagttgcatctcgttttttaattgtgaaatacgtaagacttaaaaagattatataaaacatttacgcagcccagattgacggacatcctgttaaaataaacggcctacactcttcaaaaatgtcaggatcatgaaagacaaaggctgaagaactgttccaaattgaaggaattaatgcaatttaacgagtcatgataactaaatgcaacatgtgatcctcgattggatcctggaacagaaaaaaaaattattttaaaaatcaattttttatcataagattatttttgtctcttttactgtaaaaggcaatggaaacgtcggtgaaattttattaaagtgggtagatactagtactactaataattgtgatca

SEQ ID NO: 9564 - DNA, 1767 bp, artificial
  synthetic oligonucleotide
gcatatggactaagagtttaggtctgtggtgtatatcagggtggggattgttaaggaaaagggatatctgggtattaggggaaggggtgcacagatatgtaggaccgacccacaggcctgggtgacatctggacatcgccttaccaaggagccccggtgccctcctcaagccctgcccagctccttttcctgcctggccacagcctgggatgtacctggcttccctttatctataaaaaggaaaggcttccatttattttaatatgaatttatgcacattctacaaaggcattaccacacctgcagaaaaccattgttcgtacttggagggagttttgatgatcattcctgttctgtgtatagttcacatttttacatggagatttctgtgtgtgtatcctgccttttttgctttaatagtacatgaaaataatttcccatgatgttacatagtattgataaacaatttttcaaatggttccataatatttttaaagagactgtctacctgagtttctttaatttcatattccctgtggcttcagatgtttccttttttaaggataatgctttgataagtatctttacacgcgtacgcgcacacacacatccatctctgatccatcaatctatcaaaagaagaggaggatggagaagatggaggaggtgagggaagaggaaaggaggagggctgctccttcacgtcgtgagctctgcgggtggttgcggagcctgggtgaacacgaccgtgaccgtggctgcgaaggcgggccccgccctctgactgcggactacgcggcggcgcctgtgccgcagtagcgctggaccttggcctctggcggtctctggcgccccctcccgttcgcatcgtgaagctgggccgagcccgctgcccgccgttcctcgctcctgtctgcacctcctcctccgttttgcttccctgcagcttttgccccgccccccttcccctgcctccccctggccctccgcgtgttaatttaggggccccaacccggggaacccctcgcagagccagctgctgtcgttaggcccgggtgagtgagcaggacgagagggcacggctggcgacggagcccctcccagcgctgcggcgggagagggggctcagctcgagtcgccacccggactcgccggacccagagctcctctttggggttcccgctctcccgctccccgtgctcctgggaagaggttctggaaacgaccgaatctgggtgcaatcggggtggcgcacaatcgcgcccctccagtcccctctgcgggcagaggaagtgggactcgaggaccagagctctcgggcctcctgatccagggacctgccatttcctggcccaggaccccgggaatgcccgagcatggcacctcgacgtggcaggaaaactgttcaggaggcggcagaggagcctgtgggggacgggaggcagccacctccccgcgtccttcgaaccctttgcttgggctgccgggcatcaataccccaactcacccagcaccccctcttcagaataacctcaaaacccaaccgggctcctggccacagggccttctcttagtccaaccaccaggctgagtgaatcctcgtggagccaggagggtcctcagtgaccctgcacaaacccgttatcaagtcaccccaagtgggatccaattagcatcctgtctcacccagaatcgccacttaccacacctctacctgcctctgtgtgcttggtccccaccatttctcctgcagtcccagactaagga

SEQ ID NO: 9565 - DNA, 1211 bp, artificial
  synthetic oligonucleotide
gccacccttggaagtcccagagaaagaaagtgcccagttttgggtgacccccacagacagtccttccctcccccccatcccccaccccaggctccccctaacctgcaaggctgacagagcccaccactacgtttctggtaggcaaaggcagtgttgagacagcagtcttccacgctgacaccaccccccaggaggcccttgcacttgccggaggattcttcatactgggtgaagcagagcacggggtctgagcctgtaacagggccaggggatgggtgggtggggctcggtcagggatgtggtgggcctggacacccctggggccagctgggccctcaccccctcacctgtggctggcagggtgagcagcaggagcagcggcggcagcaacaatcgaggggcctgcgctccctctgtgatcatgttgagtactgccccctgcacctctaccagagaggaggtcccgctttatctgggttgataggctcctggaatcagcagggaaagaggaacctagaggcaggaggaactgggagggcatcctgctttgaccccaccctgtcccctctgcctccttctctactctcccctccccatttcctgtcttactcttggtcttgttctgtttgttactatatccccagcacctcgcgctcctcccagcaacctcacagtgttcaatagaagctcctaggacaaattctcacccagaggaaatggagcataggagcgtgcagcaacttcctagccgtgtgaccttgggtgagtcacttaacacccctgagcctcagtttccctatgtggaaaatgcataatctctaacataatgacggggtcaacctcgtgggggtgttgaaccagggtgaagtgagtgtgcggtgctcagtatgttcctgctcgtgggggtggagggagcatcgagtcagttgctccaccttccaccctcccttaacctcggccctcctttcctgagaggttccctgtggtcagcttgtggtcggggaggtcagcacaagggaagtgagaaagggaagtggcaggagcctggggagggattcaggaggggaatggggtctatccattgttccatgggcccagctggggacaacaccagggtctggggtgattaggagggaataagctgggccatattccatcagagaaccctcaggcagataacaccccccttctggagcctgtttcccctctgt

SEQ ID NO: 9566 - DNA, 1400 bp, artificial
  synthetic oligonucleotide
aaaactaatcggaagatgcacataaagggctttgtgctggactaaagggccattgccctgtccctgccctaagagagcttgctgtcatcctgggaggatcttagagagatcagggctgtagatggaaagcccagagaggaacggggtcatgttggagatactagggatgggggtaggggaaacttcttggacaaattgacttatgagctccctgatgaacacagtgggcccgaattacatactctttttaatactattacgataaacattattaatatcaatgggtaaaatatatttctggttctttggtcttctagaaaaaaacatatatagaagttttttttttttttagtttgaatttcttttttaaattttttttatagagatgggggtctcactatgcatcccagattgttctggaactcctatcctcaagtgatccttccacctcctgcctcagcctctcaaggtgttgggattacaggcatgagccactgggactggctcattgaaatttttctttctttctctttttttttttttctgacaagatctcgctctgtggccgaggtaggcagcagtggctggatcatggtcactgcaacctcgtactcctgggctcaagtgatcctcagcctcctgagtaactgggactacaggcacaccaccccacctcgctaattttatttattttttgtagagataagggacagggtatcgctctgttgtccaggctggggtgcagtggcgtgattgtggctcactgcaacctctgcctcccgggttcaaacgatccaccagctgtggcctcccaatgtgctgggactacaagcatgagccaccgtgcccggcccaaatttctgacgttactacagagttcctaggaaaaatcccatacctgaaaaagttagaaactgacaggaaggatttgagatgacgacctgcttcatatacactacttattaaaactggataacaaatgcaccgcgggggggtggggagggataggaaaaaaatggaaagagaaaatcagcacatgagtactctgattttggaagaatctaaagagaatatcagagcatgcatactctgaacttggagtagccaatcccaggggacgctttaggcgggaaaatcagagtctccacccccactttgagaaggttgtgtccctggagcctcaactgatagaccccacatcaccttcgctcctcccacctactgttctgacttctgattggccaaatggagttcactaactgccctgattggtccatcatcctggggcagtgacattgcagaatattttctcctcctccaaccacactttgtcaccaactgctgccgacctcgccaccactgctttgtctctgaggtaggttctcttgaagggacaccct

SEQ ID NO: 9567 - DNA, 799 bp, artificial
  synthetic oligonucleotide
tttttatctgccccgacccttgctgctacaagtatatacacaggaacaagatttttgtaactgttttcacgtgtccactcttcttaatctcttgcttatggaggtgttttactggcctttattgccacacaactattactctttctagggctcttgactagctcactctacgctggtggctgattttgcatatgggtttactttgaattatctcaatgcctttcctccatccttgtgctcttttagttctgcttgcaagaaagcagataatttttcctcaatggactgcacacttgtcaacccatggagagtttgaagcttccttctcattgctctcactatattttttcatgcttctatttgagtgtttagatatatgagcaaattttagcattgccagacttagtaaatattgtatgagatgcacttttactaaaatattatttgttgttcatctgaaattcaaatttaattgggcatcttgaattttttctagcacttcctctctcacttcctgccaatgtaatctcattctcacgtacacatacggaggaagagggcatcctcagtgcctaccacagtgcacacatactataggtgctcaaatgttgaaaggaaatagtttctaggggatgttaattagttcaattgattccatgctataggtattagtgttcattacctaaagaactggtagatgagaaacagataatctccatcaatcactgtaaattatgcctaaaagaatgaaacaattgttaagtagaaaattaatttggtaaataccagataaattatt

SEQ ID NO: 9568 - DNA, 1503 bp, artificial
  synthetic oligonucleotide
aatgtaaaaagtagttacccccaaattatctttgccagaaactacctcctccacagtcaccttgctattttagcttttactccaaccctagttacattggaataattatgtacatttgtatcattttacagtttaagaaataattctggggacattttcacatataaacctcacaacaaatttgtactaaaggtatttttttttaatttcaagtttataccatgacatttatttttattttatttttcatcaacttttaagttccgggatacatgtgcaggatctgcaggtctgttacatatgtaaatgtgtgccatggtggcctgctgcacagatcaaccaatcaccgaggtattaattaagcccagcacctattaccccaacacccattagctgttcttcctgatgctcttcctccccaccgatcccgccgccccccacaggccacagtgcgttttgttaccccttactatgtgtcatgtgttctcatcgttcagctctcactagctcctacttataagtgaaaacatgtggtgtttggttctccagagccaaggtatttttactatgtctatttttgcaaatgtggaaacagattcaggtgttaaattcatttgaaactaatagcaaaagcaggacttgaatccatggagtttgagctctgagataaactcccccattctcctccttatacacatgatctccacctccactctgatttgtgagcatgaagtattttatattctcctaccaaggtactgaacattgtatttggagttgtattaatgggacgtaacacatacagaaataattgcactagacaggttagaaatgttcaggaaattcagttaaatgtagactatgacactgacctaaagacctggaactaaaaataatacccacggtaatcttaaggtgagtgcccaaatgcaatccagtaactctgctaggtaaacaaccctcatcttcatatagatgggaaggggagaaattacatttttaatttttttcatatcacaccatttcctagttatgagtacaaagcttaaagttttattgattcaatgaatatttattaaacacttatatactagacactgttctgtattttaagaatctgattataagcaaaaataaagtctttctccacctggaatgtgcactctagtttaagaggcagacattaatcaaatacagaaatgtatgtgaaagtgctgagataaatggtaccaaaaagtacctggtggtgtgggagctcataatagaatataggatctaaagaggagtgaagttcctggctttatggcttactcaattggatgaataggagataaaaaagtatggagttgctggtcatgaatttagtcttggacaaatgcagtttgaggtggctttgagacatgaaataaatgctcccagggagataagccaagacataaatttgtgagtcatctacatataaatcataattgaaattttagatataaaagaaatttcttcatg

SEQ ID NO: 9569 - DNA, 490 bp, artificial
  synthetic oligonucleotide
gagttactaccttatttctaatctattctaaagatagagtaatcatgaaaatgcagtatttgtgaaaacatagacatatagatcaacagaatagaacagattctagacataaccttacatctatttggtcaattgatttttgagaaatttgccaacataagtaatgtggaaaaaatatttttgaacaaatatgttggaacaatttgataggcatacatatgcaaaaaaattgaacctcaaccatgtctcacactctatataaaaattaatagaaaatgtgtcacagacccaaatataagaatgaaaattataaaaattttaggacaaaataggagataagcttagcaaccttggatttgacaaaaatttcttaaatacaaaaaagaacaaattaatgaagaaagtaataaaaaatcacagtttattaatattaaagcttttctttttaaaaggcactgctacaaatgtgaaaaggtgagccatgggcttg

SEQ ID NO: 9570 - DNA, 1192 bp, artificial
  synthetic oligonucleotide
tctcagagatgtaaccataggaagtaagtggttgacaacataaacctttataattaatgagggtaacttttcacctttttgaattatgttgaaatgtacacagaatccaggtaatacacctcaaggactactgttttcttcaaagttaaaatgttgtcttacagctctcaacttcctagggttcatttattcaagaaacatttgcagagtacttgctttgttccaggtatgttagatacactgttagataccatgagggataaaaaaggaatcaaacactgtccttaccatccagaagcttaaaacaaaggaggagaggtacaacatttatgcaggttagtgcactatcacgctaaatatgtttgttaagtgtcatagagagaaagaaaccaagttgtttccttgtaaaaatcatttttgcacaactaatagcatgtagtaatttattatatttgccacctcttaccccacaaaaagctatgaacatgcaaataaaatacctttgatctatagttcttgcaatacaggaaaatatataaaattgattaaggctttgatcaagaaagcttatcaattctccccttcatttataaatggcctaaagatgataactgcatccctctttcccctcaaccccatgcatacttctttcttggaatgtatctatacttacttatttacttctttatttatttgtgtctctgtatacatatatattatatgcacatgtgtataaatatgtatctacttataaatatatatttatatatacatatacaatgtagatatataaatatatatttatatatacatatacaatgtagatatataaatatatatttatatatacatatacaatgtagatatataaatattcatatctcaagaaaggagtgtgatatatttatatattattaatataagtaaatttatttagcatactaaattataaataaataggtagatagatagataaatagatagagatagatatagacatatctcctaagggaagaatgcgagggctgtgtttaaatacatatatacaatggaaggaaagaagaaaggaaaacagataaaaaaggaagggagtaagtctagcatctttccagaatcagggaattgaatgacatgtaacaatagaaccacagaattatttctcactaaccactactgctacctaaaagacatg

SEQ ID NO: 9571 - DNA, 527 bp, artificial
  synthetic oligonucleotide
acttgccttttgcttatttatcaagcagctctgaaacaccttttaaagggtcaagcaagaccttccttcttccacttttgtcttcccctctcccaaccttcattgtgtttctaatgtactcattcaagtctgtttgcttttgatataatctggctcttttaaggttctatccacaaataatttcaaacaatatgcctaaaaatgcttaaaaactagttatttccataattttcacataaccctttgtttttacttttttctataggcattctctgaatattgaacctgtttgtgtacatttcctctatggccaaagctgttcccacaaaacaaactggaaagcataaaatgaaatgtattagagttaatcataagaatgatcaaatataccttatcaaccttatggttaaattgtttgcatcatttagacatcatgttagtgttaagagagtctagattactaacagcatacatttgcatgctattttataaaccataagccattttacacattgggtctgcatatt

SEQ ID NO: 9572 - DNA, 1488 bp, artificial
  synthetic oligonucleotide
taatacatattataataatggctacaattcttgaacacataatgtgtgtcaggcattgtgcaatgtactttttaagtgtaatcccatttaatcctcacagttaagaattagtatccccatttgtcagactggaaaactgaaatttagaaagatgaagtaactttcccagtaatttggatctgaacccaagaagtcagaatatagaacccagagtcttaaccactgaaggcattggcaagcacttgtaaaggacttagcacagagcctgcacttagtaatttgctgaggatcacacatgagaggagttgctctttgtacacagactagacaccacattgaaaaggacagctgaaaaggcaaacttcaatctctctctctctcgctctctctctgccccccccaaccccccgctgcctttttcgtctagctcattctctcaccatgctccactcagccccaattctaggttccatgctattttccaagacactcatcctcgtcaattcctcgctttcccaggctgtcgttatgatccaacctccaccaccacttattagagatctgcaaccttatttaaataaaatataaaattactcttaagaaggaattaaaaaatgagggggaaaatgttgggaaatactgttgcaaccatttcctgtcctccagatctttcctgtggaatgaggttcttcaccctaaggatgctatggatggtttgtgaagaatcaagtgcaactatgtagttattaggttgctgcaaaagtaattgcgatttttgcgattgaaagtaataagcatctgtatttttttttctggaggggggtaagtaaagtacatagctttcatcagattaaaaaaggggcctatgtcataaaaaggtaagcatctttttgtttaaattaatgtttaaatcttaactagaattcttgtcatatacacagcattccccctactgtatttttcagtctctaccacaattctggtccaactcctaaggcacttcctcaccctacatccctcagacagcctctttcctgactcttatcctgcctgctttcctgccagaatttgctgataactcccagggacaagctctgtctgtggcaatcaaagggatggagaaaagtgcctgaattcacaattctccagccccacatggcacgccagctgcagtctgtgcagacctattacagcaaaagctgtgttatctggcacttctccaacataaaagaactggaaaccagcatttctaaaatcctctaatacaaatccccaacctagtaactgaaattgatgccattgaaattcagctacagtgacacaaccctttgaaagaggcctgatcaaaatccaaagctaaaagttgtctctgataagttgagctaagcagcataaacccagcaggcagaagaaaatctagccctgaaactttagattgaaacaaaacaaaaacaaaaaccaggagacagtaaagacattttaaaatac

SEQ ID NO: 9573 - DNA, 2541 bp, artificial
  synthetic oligonucleotide
ctacattttcaaaataattaaaatctcacttttatatttgaataatatgagggatcttcaaaaagttcatgcaaaatgtgtattttgaaaaaaactatgcatggatttcaatttttttgcatgaaaataaactcatagtaatgtgttataaatgcctgaacaggacccagtttgaagcactgagtataagacatcagtttgaaaagagcctctatcaaagcaacatgaattctgctaaaactgaagcaagaacaaacatcaaatttatcacaaagtttgggtggaagaatgatgaaatcgttgatgctttatgaaaagtttatggggacaatgcccccaaagaaatcagcagtttacaaatggataactcattttagaaagggatgagatgatgttaaagatgaagccctcagcagcagatgatccaaatgaatttgcaaggaaaaaattaatcttgctcatgccctaattaaagaggaccagcgaataacagcagacatgatacccaacaccatagataccacagttggttcagcttacacaactccaactgaaaaattcaagttgagcaaactttccacttgatggctaccaaaacaattacacatagatcagctgcagacaagaaaagagctttcaatggaaaattttaaacaagtaggatcaagatcctgaagtatttcttcaaagaattgtaacatgaaatgaaacatggccttaccagtatgattctgaagacaagcacaatcaaagcaatggctaggaaaaggtagaagtaacccagtcaaaacaaaagcagactggtcacaagcaaaagtcacaacaacagttattttgggatgatcaagacgttttgcttgaggattttcagaagggccaaaggactatatcatctgtttattatgagagtgttttgagaaagttaccaaaatattaccagaaaaatgcctaggacagcttcagcagaaagtccttcttcaccataacaatgcttctgctcatttctcaaacaagggcaattttgtgagagttttgatgggaaatcattaagcacccatcttacagtactaatttggctccttctgacttctttttgtttcctagtcttaaaaaccctttaaagagcacccatttttcttcacttaataatgtaaaagaaacatcattgatatggttaaattcccaggacgctcagttctttaaatggctggtatcaacacttaaaaaagcaacttgatttgggtggagcttatattaagaaacagttgttttttatttttatcttttatttccattttttccatgaacttttaaaagttccctcatactagctcatatatactgcttactatctgcccagctcactcactcacacccgctctctattttttctctctctccacacatacacacacacacacacacacacactttcatacatgccccacctttcacacttatttaatcttcacaacaaccctgcaatgtaggtactattattaacaccatttcataggtgaggaaattgaggtatagaatgactacgaaacttgcccaaggctataccactagtaagcatcagagccaggatacagacaactcaaacatactattccaaatgtttcatccaaactgtacaatcaagctactgggaataagacagactctgtcacacctgcaaacaaggctatttttctttaaataataaatttaaaatcctaatttgtcagaagaagctttaaatatctcatagtaactccctgaaaaggttttaactggatttttaaataatataaatatatacaatcacaggacaatcctatttttaaaaatgtgttgttggcacttctattcttaagctatggatacctgtatttattcagatatgcctttaaaactaaaaattcaaataaatatctccactgattgtattccaggtgctcataatttataccaattacattttctaaatatattctctattttttcattatctcaggaaacattgtcactaacatcctctttattcaatttctttgtcacttagtcattctctaactcattcatacagtaaatacttactttataccaagtattcaacaaatatttattgaatgcctgctatgttaggtatataaataggaaagacgttatataagttaaactatttccataaatataccggttacgaagtattgcagcaaccaattcccctctatgcagatgatccatcacctctaaaagttggataatgacctgttcaggaggaaaagaagccaatatttactatgaagattaacactggaattttcaacttctgtttttataatatttttatacttttcatggttgaattaaaggaaaaatgtatgcccctgtacttaatgttcatattacatcttaagaaaattaagaaattgaatcttatttaaaaaactgaaagtaaaaatatctatgaaatttaatagtgaatcactaaatactattgactaaatttcatgtgaaatcagtaactaatgattatccatggaaaagcaacca

SEQ ID NO: 9574 - DNA, 827 bp, artificial
  synthetic oligonucleotide
actacttacaaagagagcacagtcttatcttttgctaaagtcttaatgcatattcttcaccatgcagagacaaaaattattatagttattttagcaattacaccctagcagctgttatatatttttttccgactaagtctgaagttacaataaaccaaataattgttcattttaattgtattggacaaggccatttaggttgataaattagaaggtaaaccatcattaactcacaggtaaaattcacaaatatttgaaggatagtttttcctctatatcatcaataccagacaacttaaacttgttttatgtaactattacataaagcatttatgttacaaaatttgtctttaacaataatttctaaagcatatatattttctgatttttcacttaaaaatgtgtttttgaaaaataacaggtttcaagtgaataaacatggaaagcttaaaatactgccttatactatttagccagtctttgctttcctcttcttgtttgttcagactaaaaaagaaaggtcagctttccctttttccctccaattcccaatttagcatgcattaaggtttagaatataaggttaaaaaacatttctctccaaactgaagaagccactgctattttaaaatattgatttatcactgtaatgacctctaaaaaatccatgtgcttaagtgactaacattaggtaactgacatgactctctttttgctccagatatggagaaatgattatcatatgtttgacactgagactgtcttaagcacacagacaagaaaatgaactgaatagcttctgtatagtcctacttatagcctctttt

SEQ ID NO: 9575 - DNA, 1499 bp, artificial
  synthetic oligonucleotide
gtaaatatttgccaatgagtgttcaggtataagcaaagaaataataccagtttgatatttcaagtaagtctggtggtatgacctagttaagtgtctcactttgaggttttggtttgcttttgcatcattcatctatagagttgtctaagagggtaaagagacctgttggcaagagaagaaacaatgtgtctactttatttagatttttaaaagacctttgacaactaggcataattccaaggaaaactttgcatgtaggcagaaaactgcctccacagccactccacctcctcatgctgaaatcctaccctttcccatgctgtctttggtatcacttcccgcaggaagcctttcctgattccccctacctcatggggttccacgctgctctggatggcaggtgcattttgcctgtcctcttttgtggcacatcgaatagtttgtttttcatatatagagttccttgaatatgtgtctaatccccctaccaggcaaagaacaagagagaagaagtgggtcttacctctagcatccctgcagcatctagtatgagactgtatacatagtaggtatgtaatctaccattgtaatcaatggattgaatatataaacgagtgcccgctgagtgagagacactgcatgtaaaagccctgctagaatggtcaaaggtgaatctcccaggaatgttgacatcagagaaggggaagaggaaacaaaggcaaccagcttttattgagtatgtgctctttaagctctttcatatgcaggaagaaaaatcgatttgggtgtctattacgtgctaggctctgtgttaagcatttggtcatacattgtctcatctggtctcctgacaagaaccctaagggacagtcttattctccccttcatcacttttatcctttccatatatatatatgtgtgcatgtgtgtgtgtgtgtatatatatatatatatatatatatatgtgtgtgtgtatatatatatacacacacatacacacacaacacacatatatatgtgtgtgtgtgagtgtgtgtcgaaagggtctgatataatagatatatacaatatcaacatatatagatagatatcaacatatatatgtgagtgtgtatatatatatgtgtgtgtgtatccttctatgatatcaacccctttcaagggtctgattatatagatgtatatttcaacatatatatatatcaacatatatacacatatatcaacatgtatatatgtatgtatatctttatattatatcagacccacagccaaggaaaaggtacagttcctgatcataagaggttcaccagatgagtgagaaagacattcatgtaaacagactatacagaacaataagaaatcacaatacagaacaataagaaatattttgtaaaagaactttgagaaagtttcatacttaaagattttttaagcctactatgtttgttatcaagacaacacttacaagtgcagtcatgacttctgtaatccaatct

SEQ ID NO: 9576 - DNA, 1333 bp, artificial
  synthetic oligonucleotide
cacccctctcaaaacgcgtctctttggaactgcagagttagggagtaagactttctgcctgaccccacctacgtcggccgcgcgctctcagagccagggcaccacgctgctcctgcgcaggtcctagactcctcccttcgggaggctcaccccctcccttctcggctacttccggccctcaccgaacgccctcaacgcgcttgcgccgttttgataggcttctcgggccgaagtaatcggagcgctgcctctctggaaccgcccccgccacctcttcgccccgcccacgtattaccgcccctccgaaatctcgcgagggtaggtgcgcgtcggtattttgcgggcaactagctcttccagctgctgtaaattgctgctgcgggagaaactggagccgctgtagccggcgcgcccttcttcccttactgcgaggagccaccgcctctttcgcgctccttatacacctatcactgggagcggtggcagcaacattccctggaccaaccgccgcctcttcaggcggccgctttgccggtcattcccgaagcccggcaactgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataaatggcgtcggaaagcgacaccgaggaattctatgatgcccctgaagatgtgcacctagggggcggctaccccgtggggtaagtgactgcagctatgacaggaagccgggcatcccaagccccccgcatctcctgtgtcttccccctacacccctcccaggtcccgctgtgtccgccaccgctgttcctccccgtctcactggaggacttcagaacccagacctggggcttcttagggcggggtgactcggagaagggggagtcagccacctcgggcagcctcccggccgtttccctactgaacggtcccagggtcggtctcggagcccgtttctcttctgatccagccttctgtgagggggaacagcttacgtgcctgagtcggagatttgtatctgtggggttctgagcttacctttcaaacatccgttttggcctcggggaccgtagattaaaggagcagtaacaggagaaatgtaacttgtagttttttattctcccgtttaccgctaacttacctattcacttcagaggtggctgtaactctcccctatttgccgtcctctttttcttgcacacagcgaaaaggagcggggggaaggttg

SEQ ID NO: 9577 - DNA, 1089 bp, artificial
  synthetic oligonucleotide
aaagagctgaccagaattccatcacaggtctctgtgagctggggtaggcaagactggccaacaggtgcctgtgaggggtctgcagacaccagctttgtggggaaggtctaaccagaatgtggcttcttgggacagcaggtttcttttagtggatcgttggtcggagccacctatggtttcaggcagctgctaaaagaagcatggacaggcaagtactccccataccctcgagagaaacactaggctcagtcctctgatgcccctcatctctagatagaaaacaaacattccagcagaaggaataggagtgatgagactgctgtacctgagttcagtaagatttcattttttctggataaagtactttccaaatgcaagatggcacatctcttaagttctgagagccccactaacccatcctctaccaagattgcttatctagcgcaggacaaatgtgaggaggcagcccacagcccagcacatgtggggcaccatgttagcgtgtttaggctgagcattgggtttctgctggacaagtgtgtcattaactccctgaaacaggaaaagccttatgggcataaacttggctcctgattaacttgactgagtcattcctgtcaacatgctcttctagtgaacctccaatgcatctggcatctttgacagttgccacttcctttgtgcatagagccaggaagagcaatgtggacactaccagaagtccaacattttcctgggccttccgatctctcatgggccccataccccacaactcttttcctgtattctcactccctctgtcagtctttcttctttgaattcctccttcctcagtggccctcttctaatccctccaacaccctaacccacatagcctcttcctttgtgtatcctttagcctctcccagatccctgtcaggttgatccttctccaccttactctggaccctcttctaagcttctttgtgttcctctctactcagtttattctattttcctctaagccccaagatctcactctccctctgttagtcttccttctgagttggatgtttccttctcataggtcatcccctcccccaaggagcc

SEQ ID NO: 9578 - DNA, 1305 bp, artificial
  synthetic oligonucleotide
cagggatgtttgttctaagatattcattcagaaatttacttgttccaagcatgtctgagtctttgatcctcccacccatgactgggctctagttggacgtgttaggctgtttcattgtatacaaaggagccaactgactgtggttgaaactaaatccagtatctttacaaatttgtggtgtagcgtttttgtggtaataaaactgaactggttttatgtctgagttgtttatcagtgagctatggtaagagagaaattcacagttgtgatgaagctttaaggagaagaaattgaatgtaatgttggttatggaaggcagtgtcgcctcggagaaacccatgttgtatctgtcgagtaccttttctaggtgaggtgccatcccataattttaccttttcttttggccatagttcattgtttagagacatgaccttagagaataaagaaacactggctgattaaaggggatggctcaaacgtagagctgaagaaggccatgtgtcccaacatttgtactcacaggccttagaagggaaaggatttgaaggctggagtggtttggtccagtttctctttccattctactgtctgagtaacacagaaaggagagcagataaatgggtggaaattaaaattgatctccatggcaatgacttgcctccacagatggatatgtgttcaagagggagctgtctagtcccacacattcgcattccttttgtagataaatagattgaaaggtgaagaagtcaagctttcaggcacaaatcttacacattgggcccttttaaggaggtttcagtcagtcatactgggtaggttagaacagctataattatccagtattcttcaggcataatacctgttttggcttgaattacttaggtaattgagaaaaaattttgtgtttcttgtcttgagttttccatactgacagtgttattctgctcagatccacccaatcattttctgcctacaatgtctatggccttaatgaaagtacagtaaattgtccccacaatccacacttttcttcccctttgtgaatagaatataagtctgttcagacattcagcatgaacagatgaacttagattgcctgagcaatctttttctttgagagacagagtcctcccctactgaaaggaattccttcacacccaatatcttcttcttaaacttgtttttatttcaaaataccaataatttttaaaaatcgatttctgtggcagcccaggtccattgcccagctctgttagctgagctcagtgttgctcagtttcctaagcggatgcctcttactct

SEQ ID NO: 9579 - DNA, 284 bp, artificial
  synthetic oligonucleotide
tcatattagagatgagaaaactgagaaatagagaggttaagtaatttgcctgctggcaagtagtagaggtgggatataaactcaggcagtcaggctccagagtctgtgctcttaaacactacactatgttgaagttatacacgaagagctgttagagacctttacaagtagtataatcatcacttaatcatatatatgtctaggcatgttgtatacacacacagttcacatgtatttgtatatatttaaacatttggagattaaagtttcagtgcctgtgtttt

SEQ ID NO: 9580 - DNA, 1729 bp, artificial
  synthetic oligonucleotide
aattgaatcaaattaaaacttcagttgcatagtctcgccaaccactttcacaagtgatgagtggctcttgtattggacagcacagatagcgaccatttccataatcccagaaagttctgttggatggtgctggtatagattctgtatcttatccccttaccaccccacagcttattctttctggagccacactgcttgggttgaaatcctggctctcttccttactttagtgtgattttgggtaagtcccttctctctcagccttagtttcataatctgtgaaatggagatagtaataatagtgcctacttcttaaggttgttgtgagggctagtgtttagagccatgactagctgctagcatatgtagagtaagtgctcaatccataatagctattattactattggccaggcgtggtggctcacgcctgtaatcccagcactttgggaggctgaggcaggtggatcatgaggtcaggagatccagaccatcctggctaacacagtgaaaccccgtctctactaaaaatacaaaaaaatagccaggcgtggtggcgggcacctgtagtcccagctactcaggaggctgaggcaggagaatggtgtgaacccgggaggcggagcttgcagtgagccgagatcccaccactgcactccagtctgggcaacagagcaagactccatctcaaaaaaaaaatactatttattattattattattgttattatccccactcctttgcagatgcagtcagtacacagcgctggcctcttcccgtctcacagaattagtacctaacccatatctccttctttcttgctctcctctagatagatcctttctaatcaaaaccacaaaagaaagggagtcaagacacagtgctcattagcaagcaccagaaatggtttaggtaccagtataaatcacatcaaacaaactgccagagactgttttccctaacccccaaccataaaatacggagtctttcttttttttttttttcttttttttttttttggagacagagtctcattctgtcgccaggctggagtgcagtggtgcgatctcggctcactgcagcctctgcctcccgagttccagtgattctccagcctcaacctcctgagtagctgggattacaggcacgtgccaccacacctggctaatttttgtattttcagtagagacagggttttaccatgttggccaggccggtctggaactcctgacctcaagtgattcacccacctcagcctcctaaagtgctgggattacaggcgtgacccatggcgcctggcctggagtcattttttgaaatcaaaataattcattgaagccctagggcaatgacttgtgtccctgtagggacagtctggcattgaacagaccccggcctgaagagcttcagactagtcatgccagcgaattttagggattttttttttttttaccacattaatcatcttctgagttgggagaatagtctttaatttgtcaatttccttctcatatctgcagtgtgactctgcagatgaattcagtatataaattttaacaggaatcacctgctgttttaggttaatgtttcacaagaattcaagaaatgttatctattcagaaccagtattttcccttctataattatttctaaattacaacaaaattgttttaaaatttcattatctgagatccatgagcatatgcagaatactcagggtacagaaatgaa

SEQ ID NO: 9581 - DNA, 1344 bp, artificial
  synthetic oligonucleotide
gtacactctgcctgctatgcagccccaaataaggctggccagtacctaggagcactgaggaggctaatggacaattaacaaacatcgagtccagaggaggcctggattctctgtaagctttgcagccaaaggtggccctgcctgcccacttagggccccatgaagactagaactagaattacagaaaaagaatgtctgcaagtcaagaacaatctggctttactactttattttcattccttcatctgttcagttggggggcgatgttaaagctatgtgacatgggcaccaaccagtcaggtcagatgctggctataattacttggtaggttatgtatcaaccctggattcaacagatatttattgagtgtctaccatgtgccagcactgtgctagctaggtactgtatgatgcagggcaagtttctttctttctctgagcttcagtttgctcacttgtgaaaaaaaaggagtaagtgatctacaagggctcctttaggtctaacattcgcaatcaataaaatagtaacttttgattgttttgggaaaataatggaaacagctatagaaaacaagcagctgacctaagacttgtagatttgaaaatgggggaaaaaacagaaaattattctgagttattgtttgacttgagatttggattaagaatcagttctacatgtcttattttcatgatgtttccaaagggagacaaagatagctctaatcaaagggtgagtttgttttacagccttgaacattcaagctccaccccactatcccccaccaacatgcatatacaagacaccttccccctaaggaggctactactttcttttagcatcctctctccagctgctacacttcaaaccctttcgttcagtggttggcaatagcttgtccactctggcaagagtccatgttccaagcctttcttaacttcctcttttcagacttgtcctgcctcatttcctgttccttgtggcctctgcctcataagatgtttgatcaattcatctttgctaatgtagccaaggagggctaagaagtttgtgggttaccatttctggataaaattcatattacaaggagcctccccaaaccatgctaccacttttatggtggattaaaaaaatattatgggaaagttcaaacatatatagaagtaaggagactgttacagtgaatggtcatatacccatcaactagcttcaacaattatcaaaatggtcaatcttatttcatttatactgccacccatttcctacttcctacatgacgaattatttttaagcaagtcccagacatcacatcatttcatctgtaaatactttagtatatatctcta

SEQ ID NO: 9582 - DNA, 491 bp, artificial
  synthetic oligonucleotide
taatgcagctgaagctcaaatgggatagctcaccactttgaagtcagacttgttatcgtaagtcatctcatcatcattcaaaatgaaagagaaccccatttcgtttcctttccttagaacaagggcttcagaactccccagggctagctagtctcattggatcgctgaccttttcagtattgaaattcctatgcaaatttccttctcagcatcccagggctttgatcctttgtgcgatgaattttatttgtcgaatggatgaaaaatgcagttatcagacatgcccaggtcacctttggagagtgttgtgataacaaatgtccccaaatgcgaccattgattttctcttcctttgaggaccttaaagagcctctaggttaaccccattatcatcagatcatcagtgatcacttctcagaagtttagctagacagaaaaagtggatgaaattgaactgaatttgtatcaatcccagtcattgcctaaaatct

SEQ ID NO: 9583 - DNA, 3707 bp, artificial
  synthetic oligonucleotide
tccctctgtcctgtcttattagaaagaggctctagagctggctgcatagtacctgttctctgggaccttggtgttgatctaagactggtttaactacctaaagagaagcagagacccgagggggcctgccataacccaactctgaaacatgacttaatcccaagtaagatcagctctaacatttgttcagaagcaaaaatgatggattctaaagtttgacttccccaaggtcatctggctaagaggtggctgcagcagggggcaacaataggtcttcaggcccctggggcggcaacctggcactgcccaagagcccgcaggctctgaaggccaactgagccagcggcaagcctagtccctgcctccctgcttggagcagtgcgactataccgttttctgtctgctcatttgtgagcttggttcccgtcctaaatgtgggggttcaaggcagacaaagagtgtgcagttggccaccccgctcgccttcaggaagtgtgtaggacaccgtcgaggccccctagccattgtaaaccaggcgctgaggctcgtgcccagttgtacccttcccgcgcagcgctcaggagcgacaaacctggaggctattcggtctgccactgggctgtgccgggattcgcggactttctcctgaatagcgctctcagctcgcgtcttccccctgccactctcccacgcccccagagtacccaccgaccccagcaggccgggtacatccctgccgcgcccatccggccagtggctccaggggccggcctggtgtgtctccagctgggcgcctaccgcctgccccagcgctagttctggcgttgggggtagagaggtaaagaggggagttagcggggcatctccctcccagggctgagccggcaagcgcatcttctccgcgagttcctcactgtccagcgagcgctgcccaacttctgcgccggtgggacccgctgctctgagtcactcttggcacagaacaccaagcaccctcagaaaccgaattcaccacctttgggaggctcctgggagaaggcaaggaacccaggcggggctcccagggctctcgggctgggactgggttgtgtgtgtgtgggggggcttcacggatacccctcccaacctgcttcctttccctgacagcagccatctcccccaagagggagagtcttaggcgtcccggaagaccctgcggactgtgcacctcgaggtaccagcctctcctgggaggagtggggggccgctggtcagcggctggcagaggggacctgtttgctggcccgtttggaggtgggatggagtggggtttggagactgagaagcccaagagaagacactgagtttctccccaccccacaaccccacttccgaaaaagaaccaggtggtgaggaggaataaggcgaagtgtaaacacaaacaacctcaaaaagaagccaagaaaagcgaagcccaaagaagcaagagcaacactgttacaaaactgtctggttttgtaacaatttccccgccgccggccaatgaacagcgtggcggcacgtcacgtggtaccgttttatataacactttgctgagacaagacagttattaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtccggcatggaattaggtcaggagagcactggttgcataagggccgcgagcggcccgggtcgggcgcccctcccccgcgcgagcgggcgggattgtgtaaccgctgaggtaactgaagtgggccaccacgctcgcttcggaaaccatcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagc

SEQ ID NO: 9584 - DNA, 552 bp, artificial
  synthetic oligonucleotide
cggaaaacataaattgccagaagattgttatagcaacatccatactaattaacatgtcttaagaaaggccatgcgtgtttatcatctaattagaatcatacaatcaaaagaataaagagtacttccttgggggatataaaataaataaataactacaatattttcattaaagttggcaatgttcctttgaacctatttgaatgctagaaattgatgtataaattaaatggttttatagtttagatttgatatttagaagagatttagaccattagtgcaaattattttaaaatgtattttgtgtttgaaaaatactatgatgcttacaatgctatgtgaagaaaatgagctacaactcatttaaaatcgtgaataaaagggtgttttagagactgatgtccgtattcctatgagacctgaaaaattttccaaagttcagagtgtttgacaaaaaaatgcaccaattcctagatatggggtttgccaaattgtaacccacaggccaaatccatcccatcactggttttttgtacagcctacacgctaactaca

SEQ ID NO: 9585 - DNA, 646 bp, artificial
  synthetic oligonucleotide
cctcctcctctctattgcaggggtctgtcactgtcttttttttttttttttgagacggagtctcgctctaatccactgttgcccaggctggagtgcagtggcacgatctcagctcactgcaacctccgcctccctggttcaaccaattctctgcctcagcctcctaagtagctgggattacaggtgccggtcaccacgccctgctaatttttgtatttttagtagagacggggtttcaccatcttggccaggttggtcttgaactcctgacctcgtgatccactcacctcagcctcccaaagtactgggattacaggcgtgaaccaccgtgcccggccgtgtcactgtcttaagacacataaacccccgttttgactgctttgagcttcctttcctgcttttgcctatagggggagtcagtacgtaatgaaaagacagaaacttggaacctgtcttttaactatcccataaactatcccaaaaatcagatcactaaaagttcttgacccgaaaattctgcaccaccatgtgctcttgaggaatgtttagtaacggattgaaagcataactaggagttctcactggccaattctgagtaatgtgagcaccaatattattaaagacagtaatgaattataaaccactg

SEQ ID NO: 9586 - DNA, 1544 bp, artificial
  synthetic oligonucleotide
gcacactcagagaaacacgcggacttctttgggtcacagacagaaccccggcgccgccgccgcccgcccgggaagacacgagcgcgcgcgcgtgcacacatacgcgcacaccgatacacacacagacgcagtcacatatgtaatgcatatagagaaaccctatcccagccagtcacctccccgcccccctcgccactcaccgccttctgccccaggctaaccccagccccgcgcctctttgcctgtgcggtcccgggtcacaacgggcagccgtgcgcaggggcgcggcaaggccagggtgccagggacccggagggctcggcggctcctacggccattcattcggcaacgccccagccgtggggccgcagctgcagcgagggaggcggtggcgctcactgcggctcttgggcaatgcaagttcagccgccggcccgcaggttttgcctgcccccctgccgccccccgccccccgcgcgccaccaccgttttccgggacaggctgagggactgagctgctgaccccgggagcagaagtcccaccgtgcccttggctcctggatgctgcccactgccctcctcgcgatgtggcggcggcggccaggtctccttgaccctcaccaggccctcggccccggccctggcacccaagctctgcacttaccacctggcgagctatatcggtcgctgccatcgctcctgcgtccgccagggctgccacgggtgccgccgcaacgggagctactgcacaggaaacagaggagctcctccgacaaagagaaagtgttacacttcgggcgcgaccaagtccggtggggggaggtgcaagggaggggccccctcgccgctgctccaaccccaacctcccctctaccgcccaccccttgaaagtagggtatggagagggggcggatttaacgcgccgcttccccctatggccagaccagttccagttcttcctgcaaccccagccataggcttctacgaaggggggcgggggctcccctcggtgaccacgtcctctgccccccccgccacttggctccgtggtacgtcccgacctctgctgaattgtcacacccccctgctctcctttacatccctaagtccccagaccccgaaggctggaagggagcccccgcccctcccccctcccatactctgctcagcggccgagctctgcagttctcctcccggcccccgttaccccccttcctttccaccgagatcccaaggtgcttagatgggtgcgccttggccgctggagtctcgatgccccactgtcgtgtctccctccctccatggcccgggagcgcagctgcggccgaggtaccggggaggcctgcggcacctgccgctccacagtagagcttagaaagggggcccgtggggggagccgcactgcagcccggcaactgagctgagctgtggcatgtggggtccgaggctagaggtcttgagacgctgcttctgccctggggtttccaagccttgggtgctgtgggctgtaatttcgtggagccaagctcaccacctttgggtac

SEQ ID NO: 9587 - DNA, 2812 bp, artificial
  synthetic oligonucleotide
aaaaagaaaaaatatccttttttaaaaagcccctaagctttgaatttgtagaaagcggggccctggggagagagcagggatgcatctctaaagagaacagggcgctcctgcggcgccggctcagattcacctgtagctgcttctccaagccaacctgggaaaattgacgggagggaagagggtggagagcaggacagagagggcggtgcagaaggggaatatccctcctgagttccctggaagagcgtcagcctggaccctggtcttgggcttctctgctggaatcctgggcagccccgggtgctgcggcgagggtcaaggccacacaaagggcaaggcaggcagacgagccagtcacatggggcagtcgagctgcctgcgtgaatgctaggcgcgggacaatggcaactccgggacaaagtgcagggagactcctgaagagataagagggaagggcgaaggaagggggcggggagccagagcctcggagctccaggaccgcgctttgggagaccgtggctggaagccgagctcggcccgctgcggaaggggcgccctcgcgcctctacactctagccccggctgggatgctgagaaccgcggcttccagggccgcaggcgagctcccagccagtccccgcgcccgcccttcggtgctggaggcggggctgccgagctcacctggccgtttggggtgggaccgcccgcgacccgggggagctgcagaggcggcggtacccagggaagtggagctgggcttgccctggggacttggctggagctcacacccctccacgccccccaaggcctgcgcgggggccctcccctagctccctccctcctcctcctcctcctcctcctcctctcctttgctccctccctccgaacccaattgctcaagcagcttccttccccaacgccagcgccagttcctctcccgttggggcccgggaagggcagctaacgctggacactgggacggccgcggcggcagcttcaagaccatggcccagctcggaggggccgcgaaccgggcacccacggcctctctcgcgccgacctcgcagagcctgcggtgcgccccgcagccccgcccctcgagagcggacactggtagcctgggcaggtactggggcaaagccgcagccgccgcctcccgggagcaccccttcccaggcacgctgatgcactctgcagcgggctcagggcgccggcggggagcgctgcgggaactgctggggctgcagcgggcggctcctgcggggtggctgtcggaggagcgcgccgaggagctgggcgggccgagtgggccgggcagcagcaggctgtgcctggaaccgcgggagcacgcgtggattctggcagccgccgagggccgctatgaggtgctgcgggagctgctggaggctgagccggagctgctgctgcggggcgacccgatcaccggctactcggttctgcactggctggccaagcacgggcgccacgaggagctcattctggtacacgatttcgccctacgccgggggctgaggctcgacgtgagcgccccaggcagcggcggcctcacgcccctccacctggcggcccttcagggccacgacatggtcatcaaggtgctggtgggcgccctgggtgctgacgctacgcgccgcgaccacagcggccaccgggcctgccactacctgcggcccgacgcgccttggaggttgcgggagctgtcgggagccgaggaatgggagatggagagcggcagcgggtgcaccaacctgaacaacaacagcagtggcaccactgcgtggagggccgcgagcgcagtgggcgcgacggctgtggagacaagcaggagagtggcagcgtcgcggaccaaggcgaaggacaccgcgggcagccgggtggcgcaaatgcatagccttttccgccatctgttcccctcattccaggaccgttgacagggacagagactggagagctaggaggggctgtgacactgtggcgatggctaggtcctgggttgtcccgggttccaccgaaggagaggcgccttggacgctgcttgggcctgcaaggaacagaacacgtcggggtccgactcaggtacttgtctcaggtctcctgtaaccaccggcctggaggacccggggactcgggcaccacctcaccaagagagagtgaaggaccaagctggcctggctccgagttccaaagctacaggactaaggagttgggagcagggagcgtggtcctgcttgggagagggcaagttaagcttccaggggccatttctgggcaggccgacgcgctgggtttattaggaaacattcgctagaagaatgagttaagattgtaaaccaccaatgcagagaaaacgcctaactctgccggcctcgctcggccattaatgggtcttggggtgcgggtagagtcagcctctgacaacctcctcctgagacgacccagccttactggtactttttctcatgtatcacaggttacttcttatgtatattaaagtggaatatgtgttcttttcacatgacaaggctgtcctttcagtgttttcccccacctcccttactaaccacaaaggaagaaactgcatatgtttgcagggtagaggtcacccaaccatggccgtgatgttgtgccccccggggcaggctctgggcctccttctcagaacaaatggccagagctgtgcacagaagaagctacttccacttggatctgaggagaaacatacagttcacctctgtcctgagctctttgatggtctggcctcaggcaccagcctcatcctagaagagttgtc

SEQ ID NO: 9588 - DNA, 1011 bp, artificial
  synthetic oligonucleotide
aaaagtcactgtcctactaaactaagttaggtgttccaaaaagataaattagagagaagtcctagatgtggcacttgaggtgatgggaattcctggagttctctcctagacctctaacatcagaaagggtgacacatctaagccattatattgcttgtttctatgtgtcacttgatcaagtcttccagatctaaatctgtaataaaaccagtatcacagctatgtgttattgagtccttaccgtgttttctttataaaatacctgtaatagtaacaaatgatggaaattaaactagatgattctaaagtaacaatctgatataaaatatggtcctagtccttatccaacataaagagttgtgtaacagctatctaacataacattacagaggtctcaaaatctggagccagtgtaccttaaatggcaattattttggtttttcagttcttgtatttctttctttctttctttttttttgagacggagttttgcttttgttgtccaggctggagtgcaatggtgcggtctcagctcactgcaacctccgcctcccgggttcaagtgattcttctgcctcagcttcccaagcagctgggattacaggtgcccgccaccatgcctagctaatttttgtgtttttagtagagatggggtgtcaccatgttggccaggctggtctcgaactcctgacctcagcaactctgcccgccttggcctcccaaagtgctgggattataggagtgagccaccgcgcctggcctcagttcttctattcctgttcaacctaatactatgtgtgtagctaattgtatatccaaagaccagaaaataggagtgacaacttcagctactttatacaaagttacctgggtatggaaattttcccatgacagttcaaaccttcttctttataaatataatggaaaccaaaagtcaaataaataatcataaaaatggtgaggcctcaagaagcacctgttaaactttgaaacctgatttttttccactat

SEQ ID NO: 9589 - DNA, 868 bp, artificial
  synthetic oligonucleotide
tttaatgctgtaaggcttttccatttttggtaatctgatgcatgtgaagtacaataccttacagttttattctgcattcctctgaccatagtgagattgatcttattaatgtattggtcattcgggtttccttttctgtgaatcccctattcatattctttgctcgtttttgaacttacctgtttttcttattgacttatgaaacctacttatattttctgaatattaatcctgtgttggttatatgcactatgaatgtcttctcccagactgtaagttgtctttctgatttgtatgcggccttttgattagttatattggaactatctctccaatgttatttttgtgctttgtattaactttactttttctaggcttctttccttctttccctgtttcactgatcatgtttcccccttctactggtttggatgttggacattctaattctttttgagtcagcctaaaaatatatattttaatttatatacagtataattcatttttgttgtacagctctgagttttgacaaatgcagagctgtgtaaacactactacaattaagatgccaaagagtttcatcatgcctcaaattccctcttagtacccctttatatatccctcctctcacccccacccatgctaattactgatctgttttccactgttagttttgccttttgcataatgtaatgtaggaattataccttatgtagccttttgactttggcttctttcacttaaaataatgaactgcagatttatttgtgttgttgaatgtatcaatagttcattcctgtatattgctgagtagtagtattccattacacagatgtaccattatttacccattcagcagttgaaggac

SEQ ID NO: 9590 - DNA, 1110 bp, artificial
  synthetic oligonucleotide
ttaaatgacatgacattcttcataggcaccaatccaatgtcagtatctgcaggctgaagtacagacagttacactgaaattgcgtatgctctgaggaatgacactaaattcgcttccaggaaaattactcaattttgtaagtaattttcagttttttttctcagggatatttttcaactttcactttaattttctttagttgcttagttgtacattttgagaaggcaaatccattggaacttggggaggcttagaacataaatcagtattagaagtaaagggaacacacagctaaaagttttactttaatcacaaattcacaactagagatatcatttgcatatcttagaacgctaaagacctgttaaaattttttaaccaatcagcaaaaatatgtgccccacagatttctaatgttcataatttagaatttatcacatataatatttattaatagtttatttgcaaaattattattcttaaaacacttctttccaacacatttacaatgttcatgtgttttaaagaaaaaaaccaccctcatttaaaaatgtactactgactttaatgtgtggttataccagtgccaccaaattagaaaagaaaaagaaacatacagctgtattggatatgtagttactactacaaataatgacaacacacgtcctatacaaagatcatattcacgcttttctaccacttctcagtcattgtcagaaccatttggaggtaagaaaaccaatgcatcattgaaaatatgcccaaatgccctaaggcggtataccccatacatcatcacatgcatctgatttggagtcagtccattaaaagtaacagccatatctgaacaacagccttctactacctggttggggtgataagtcattgcctctttaatagaaagcccaacagatttggtattaaatacatcttttccatcagcatcttctgcattttctgcaaatactccagcatatttcaggcaaactgctagctgtttatcttcagatatcttccaaatcatccctccctgttcaggacacttttctgggatattgagaaggctgttaagtcttttcattgattctacacttaagacaattcctcctt

SEQ ID NO: 9591 - DNA, 567 bp, artificial
  synthetic oligonucleotide
taaactgtcaaagggtcctatggctcaaaaaatatctagacactttagttgataacacatttgtattccttattctaattttgacttgatgtctccctatcacccacaaccagtataatttattacttgtcttctgtgtaatacacaggaaagaagtacctctcttccaagtcctgtatgcagggctagctccccaggacctgctccttttactccctgccagagcaggagccagagcaacctttgctagcaaccccagaaaatagatttagccaattatcatttactagcaacaggagggcctgatggatgactttaatatattttagttttctactgctcaagtaattctcataattcagttggttttatattataatctattttagccaccgactgttgggtaaatattgaatccctgactcctgtgcgattttggcaagcctagccttgcccttggcattatgaaagaagcagattgaattatgttccccttcacattttcttttatcaatctccctctctcctcctcttttttgttaatactttctcccctttcttactcag

SEQ ID NO: 9592 - DNA, 1124 bp, artificial
  synthetic oligonucleotide
ttggcctgtataattttactgttgttgttgttgttaatgggcagccaccacttcttctctctccttcatggggcttatttgttcattctatttagggttggcaggttcatcaaataaaagtgcaatatgattccttcatatttgttcagcacttcacaggttatgaggaagcaggttaatgtattagaatgcagaatggcagaaatagccttgctatctaaagtgtgtccccccaactgatagcattagcattaccttggagcttcttagaaattcaaactctgaatcccaccccaaacctactgagtcagaatctgcattttaacaagacctgcaggtgatcatgtgtacactaaaatttgagaagccctgggctagttctaactgcctcctccatttgctcaacagctgtccctaaactctggagtaggaaaaagggagtagagttgcccaaaatatgaactcttcaattggctccttcctatattgtagggactatcacacatgtggtggtcttacagggcagtgcataataaacagcagataatgttaagttttctgtcagggccatctgctcaaacaaagtcagaaaccacatccaaaaagaaaccacatctgtagtatgatgaaggcactatgtctaggcaaggctggacctgagtcaagttgtcatctctgcctggttgggatatctatgcctgtgaatattcttgaactctcccttttggctacaattcttcactacaaggttctctccctttttctttcagatactgagtgtcctcctcaaccaaagtgaacatttagaaaggcatgtactctactgtaacattaagtacagtaggtgtttctcctcacctgggctctatattctcagttctttgcaaacatcctcttaaagggatttcattcccccaagtagctattggaatagggtattttggaagggtctgggtcacatactccacctaagaataaagccagctctgcttctaggctctcagcctcagccttacccatattctcaaatctctccactcgctcagcctctcatacagttgcccttcctgccttcacaagtctctgtctctttccacttctctcctcccaattcgggtcaggct

SEQ ID NO: 9593 - DNA, 849 bp, artificial
  synthetic oligonucleotide
agcctactagccaaaccacagatgaggactggatacatacgattttctgtacaaccatgaaaacgtgatgcagtacagaattcattctgcagtgtcaaacagttaatccacacaggaaatgacttcatctggaagtgtctgctttgagagactcaagctcacttggtatatgctatatggcattgttccctgagtgtagagatttcctatgtcttatgaagtattgtattccactcagtatctaatgaagttagttcctcatgagtttgtactaggtgtttagtcaatgaagactgtatgtatgcctgcaaaatgtctgttttgtttgatttaaaaatatccttctagcagagtattataaacaattggtgttaaatttctaaacaagtactgccagtttgggaggggacaaagtttatggcaaggattatgggtatgggaggtaaaggcaggagatatgtgtgcttagtcaaaagtaaggcattgaacaaaactaaaacatgaacaaaacctggaacgaatcacactaatttgctaaatgtgtgtgtgtgtgttgggggggcaacctggtgtagcagaaaaagcatagattttacagttggacagacttggattccaattcaactttgctcttagggaccctgaatgagttacttaacttctttgagccacagtttcctcatgtgtaaaatgggtatgatcattgattaaaatcttattataaaatgaacttaagaaaaataaacactcaccaaagaaaatgatccttttattatcattgaggcaaacaaagcctccaaaacacatagaaatatctttccttattaattgttgcgttaatagcctata

SEQ ID NO: 9594 - DNA, 8473 bp, artificial
  synthetic oligonucleotide
tagattaaagctccaaataaagaataggggcatcaaagaagactagtcatgccttatttgttaactgtatatattatgttatatgttgatcataaatagcagttcttatcatagctcatccattcatttacttaataaacacttattgagtaacactctgggccaggccatatgtttgggatacagagatgaaaatgatacagacttacccttcaagaaacttaggagatagacaaactgacaatacagtgtggttattataagtaacataagtactatgatagttgcatgcccaggatgctgtggaagtataaaggatgaattcttcatggtaagcatagggagggtttcacagaagaggtaacatttaaactgagtcttaaaggaaaagtaggtatttttagaagaggaatggaggggacaggtatgttaggttgaggaaatagggtgtgcaaaggtaaaagcacattaaacaatgtactatatttacacaatggtaacaaattaaaggtggctgggacattgtttgcataggggatagactatcagaaggagcaatgagagatggttgtatgagaagtagatgaggtccaaacagagtagagttttatatgtcatgctgagagggtttgtactatattatgaaggaagtaaagacttaatagaagcatgacatagccaaattgctttttcttctcttttttttaatttttagagattactcttgtgacactatggaggatgaactggaatggggagattggaggctgggagagtggacaggagcttgataaagtagtctaatcaagtgataatttttcaaagtcaggtcaggattaataactctcaggatcgtaggccttttactagaccttctttcctggaagaactacctttcccagggtcatgaaagaaacttctttttcttttttttaagttcggggtacacatgtaggtgtgttacataggtaaacttgtgtcacaggggtttgttgttattatgaaggaagtaaagacttaatagaagcatgacatagccagtttgcattttcttttcttaaatgttatttcatcactcaggtattaagcctagtacccgttagttatttttcctgaccctctctctcttctcaccatccaccctctgataggcaccagtgtgtgttcttctcctctatgtgtccgtgtgttctcatcatttcgctcccacttataaatttactgcacctatcaacccatcacctaggtattaagccccacatgcattagctatttatcgtgatgctctccctcccctcacctctataacaggccccagtgtatgttgttcccctccttgtgtccatgtgttctcactgttcagctctcaattatgagtgagaacatgcagggtttggttttccgttcctgtgttaatttgctgagaatgatggtttccagcttcatccatgtccctgcaaaggacatgaactcaaccttttttctggctgcatagtattccatggtgtatatgtgccacattttcattatccagtctatcattgatggacatttgggttggttccaagcctttgctattgtgaatagtgctgcaataaacatatgtgtgcatgtgtctttatagcagaatgatttataatcctttgggtatgtacccagtaatgggattgctgggtcaaatggtagttctggttctaaatccttgaggaattgccacactatcttctacaaaggttgaactaatttacactcccaccaacagtgtaaaagcatttctatttctccatatcctctccagcatctgttgtttcctgactttttaatgatcgccattctaactggcatgagatggtatctcattgtggttttgagttgcatttctctaatgaccaatgatgatgagctttttttcatatgcttgttggcggcaaaaatgtcttcttttgagaagtgtctcttcgtttcttttgcccactttttgatggggttgtttgcttttttcttctacatttgtttaaattcattgtagattctggatgttagccctttgtcagatgggcagattgcaaaaattttctcccattctgtaggttgcctgttcactgtgatgatagtttcttttgctgtgcagaagttctttagtttaattagatcccatttgtcaattttggcttttgttgccattgctttttgtgttttagtcatgaagtctttgcccatgcctatgtcctgaatggtattgcctaggttttcttctagggttttgatggttttaggtcttacatttaagtctttaattcatcttgagttaatttttgtataaggtgtaaggaaggtgtccagttttagttttctgcatatggctagccggttttcccagcaccatttgttaaatagggaatcctttccccattgcttgtttttgtcaggtttgccaggatcagatgattgtagatgtgtggtgttatttctgaggcctctgttctgttccattggtctatatgtctgttttggtaccagtaccatgctgttttggttactgcagccttgtagtaatgtagtttgaagtcaggtagcatgatgcctccagctttgttccttttacgtaggattgtcttggctatatgggctcttttttggttccatatgaaatttaaagtagtttttttaattctgtgaagaaagtccatggtagcttgatgaagaaatgggtaatatggccattttcagattcttcctatccatgaggatggaatgtttttccatttgtttgtgtcctttcttatttcattgagcagtggtttgtagttcctcttgaagaggtccttcatatcccttgtaacttggattgctaggtattttattctctttgaagcaattgtgaatgggagttcactcacgttttggctctctattattggtatataggaatgcttgtgatttttgcacactgattttgtatcctgatactttgctgaagttgcttatcagcttaaggagattttgggctgagacgatggggttttctagatatacaatcatgtcatctgcaaacagggacaatttgacttcctcttttcctaattgaataccctttatttccttctcctgcctgattgccctggccagaaattccacactatgttgaataggagtggtgagagagggcatccctgtcttgtgccagttttcaaagggaatgcttccagtttttgcccgttcagtatgatattggctgtgggtttgtcatagataactcttattattttgagatacgtcccatcaatacctaatttattgagagtttttagcatgaagggttgttgaattttgtcaaaggccttttctgcatctgttgagataatcatgtggtttttgtctttggttctgtttatatgctggattatgtttttgatttgcgtatgttgaaccagccttgcatcccagggatgaagcccacttgatcatggtggataagctttttgatgtgttgctggattctgtttgccagtattttattgaggatttttgcatcaatgttcattaggaatattggtctaaaattctcttttttggttgtgtctctgccaggctttggtatcaggatgatgctggcctcataaaatgagttagggaggattctctctttttctattgattggaatagtttcagaaggaatggtaccagctcctccttgtacctctggtagaatttggtgtgaatctgtctggtcctggactttttttcgttggtaggctactaattattgcctcaatttcagagcctgttattagtctatttagggattcaacttcttcctggtttagtcttgggagggtgtatgtgtccaggaatttatccatttcttctagattttctagtttatttgcatagaggtgttttgtctgagcaaataaatactatgtttcatcatagtattctctgatggtagtttgtatttctgtgggattggtggtgatatcccttttaacattttttattgtgtctgtttgattcttctctcttttcttctgtatttgtcttgctagcggtctatcaattttgttgatcttttcaaaaaaccagctcctggattcactgatgttttgaagggttttttgtgtctctatctccttcagttctgctctgatcttagttatttcttgccttctgctagcttttgaatgtgtttgctcttgcttctctagttttttaattgtgacgttaggttgtcaagtttagatctgtcccgctctctcctgagggcgtttagtgctatatatttccctctaaacactgctttagctgtgtcccagagatcctggtacattgtgtctttgttctcattggtttcaaagaacttctttatttctgccttaatttcattatttaccaagtagtcattcaggagcaggttgttcagtttccatgtagttgtgcagttttgagtgagtttcttaattctgaattctaatttgattgcactgtggtctgagagactgttttttatgatttccattgttttgcatttgctgaggagtgttttacctccaattatgtggtcaattttagaataagtgtgatgtggtgctgagaagaatgtatattctgttgatttggggtggagagttctgtagatatctgttaggtctgcttggtccagagctgagttcaagtcctgaatatgctttttaattttctgtcttgttgatctgtctaatattgacagtggggtgttaaagtctcccactattattgtgtgggagtctaagtctctttgtaggtctctaaggacttgctttatgaatctggatactcctgtattgggtgtgtatgtatttaggatagttagctcttgttgcattgatccctttaccattatgtgatgcccttctttgtcttctttgatctttgtttgtttaaagtctgttttatcagagactaggattgcaacccctgctttttttcactttccatttgcttggcgaatattcttccttccctttactttgagcctatgtgtgtctgcatgtgagatgggtctcctgaatacagcacaccgatgggtcttgaccctttatccaatttgccagcctgtgtcttttaattgggggatttaacccatttacatttaaggttaatattgttatgtgtgaatttgatcctgtcattatgatgctagctggttattttgcccgttagttgatgcagcatcttcatagtgtcaatggtctttcaaatttggggtttttgcagtggctgttaccaggttttccttcccatatttagtgcttctttcaggagctcttgtaaggcaggcctggtggtgacaaaatctctcagcatttgcttgtctgtaaaggattttatttctccttcacttatgaagcttagtttggctggatatgaaattctgggctgaaaattcttttctttaagaatgttgaatattggcccccactcttttctggcttataggttttctgcagagagttctgctgttagtttgatgggtttccctttgtaggtaacccaccctttctctctggctgcccttaacattttttccttcatttcaacctttgtgttcctgacaattatgtgtcttggagttgctcttctcaaggagtatctttgtggtgttctctgtatttcctgaatttgaatgttggcctgtcttgctgggttggggaagttcgcctggataatagcttgaagagtgttttccaacttggttccattctctcagctttcaggtacaccaattaaatttaggtttggttttttcacatagtcctatatttcttggaggctttgttcgttccttgtcattctttttcctctaatcttgtcttcatgctttatttcattaagttgatcttcaatctctgatatcctttcttctgcttgatcaatttggctattgacacttgtgtatgcttcacgaagttctcgtgctgtgtttttctgctccatcaggtcatttatgttcttctctaaactggttattctagttagcaattcctataaccttttatcaagattcttagcttccttgcattgggttaggacatgctcctttagcttggaggagtttgttattacccaccttctgaagcctacttctgtcaatttgtcaaactcattccccattcagttttgttcccttgctggcgaggagttgtgatcctttggaggagaagaggcattctggtttttggaattttcagcctttttgcactggtttttcctcatcttcatagatttatatacttttgttctttgatgttggtgacctttggatggggtttttgagtggacatcctttttgttgatgttaattctatttcattctgtttgttagttttccttataccagtcagtcccctctgctgcaggtctgttcgagtttgctggaggtccactccagaccctgtttgcctgggtatcaccagcggaggctgcagaacagcaaagattgctgaccgtgtcttcctctggaagctttgtcccagaggggcaccagccagatgccagccagagctctcctgtatgaggtgtcttttgacccctgctaggaggtgtctccgagtcaggaggcacaggtgtcagggacccacttgaggaggcagttgtgtcccttagcagagctcgagtgctgtgctgggagatctgctgctctcttcagaggcagcaggcaggaacgtttaagtctgctgaagctgtgcccacagctgccccttcccccaggtgttctgtcccagagaaatgggagttttatctataagcccctgagtggggctgctgcctttctttcaaaaatgccttgcccagagaggaggaatctagagaggcagtctagctacagtggctttgccaagctgtggtgggctctgcccagtttgaacttcccagcggctttgtttacactgtgcggggaaaaaacacctactcaagcctcagtaatggtggacacccctccccccaccaagcttgtgcatcccaggtccacttcagactgctgtgctggcagcaagaatttcaaaccagtggatcttagcttgctgggctccttgaagtgggatctgctgagctagaccaattggctccctggccacagccccctttccaggggagtgaatggttctgtctcactggtgttccaggtgccactggggtatgaaaaaaaactcctgcagctagcttggtgtgtgcccagatggccacccagctttgtgcttgaaacccagggccctggtgatgtacgcacctgagggaatctcctggtctgcaggttgtgaagactgtgggaaaagatagtatctgggcctgaatgcaccgttcctcacggtacagtccctcacagcttcccttggctaggaagggagttccccatccccttgcacttcctgggtgaggcgacaccccaccctgcttcagcttgccctgcataggctgcatccactgtctaaccagtcccaatgagacgagccaggtacctcagctggaaatgcagaaatcacccatcttctgtgttgctgtcactgggagctgcaggctggagctgttcctactcagccatcttgctagccatctctgatctcgttcttttttatggctgcataaaattccatggtaggtatgtaccacatttactttattcaatctaccattgatgggcatttaggttgattccatgactttgctcttgtttataatgctgaagtgaacatataagtacacatgtatttacgataaactgatttgtattcctttggggatataccaaataatggaattgctgggtcaaatggtatttatattttaagttttttgacaaatcgccacaccactttccacaatggttgaactaatttacattcccagcaatggtgtataagcattccctttctccgcaacctcaccagcagctgttattttttgactttttagtaatagccattctgactggtgtgaaatggtatctcattgtggttttgatttgcatttctctaatgatcagtgatgttgaactttatttcatatgctcattggctgcatgtatgtcttttgaaaagtgtctgttcatgtcctttgcccgccatttaatggggctgtttgttttttttctgtaaatttgtttaagttccttatagatgctggatattagatctttgtcagatgcttagtttgcaaaaattttctcccattctgtaggttgtctgtttatgctgtttatagtttcttttgctgtgctctttagtttaattagatcccatttgtcaatttttgcttttgttgcagttgcttttggcatctttgttatgaaatctttgcttattcctatgtccagaatggtgttgcctaggttgtcttccagggtttttatagttttgggtttaatattgaagtctttaacccattttgagttaatttttgtaagaaacttctttttcttaaggttttagatct

SEQ ID NO: 9595 - DNA, 469 bp, artificial
  synthetic oligonucleotide
cagatagcacctccaattccttcagttccatgggatctatgaatacctctacatctgtctcttaccccattatattaaaattatatatttacatatttctcttcctcactaaacagagctccttgagggagaagctaacggcacccaaaatatttcaaatggtggtaagtggtatagagagagcaaaggcagtggtcttaagtgcctgtcagaagcaggtttgagctttcttcctgttcagcagatgcctgctctctcattggcttacatatttgtgaaaagttgttatgcaattattcattaaactactggctcgaaatgtttgcatttgcaatggatgtccttaatgccttacctctagggaacaatggaatttcagaaactgaggcaggctgacatagagacatagtttccttggcccttgtaccacatggtgtaggcagctgtccattaagcctgtgctttctta

SEQ ID NO: 9596 - DNA, 2066 bp, artificial
  synthetic oligonucleotide
tttaaaactctttttctttagtcttagatgatagccttgaaatatgctttgaaactttttctccctttttcattatacagtaccttgcaccatgcacactcatctaattatatggttgcttaggaattccaggggctaatcttgggacaaaccagaaacagagtccctttggagtcctcccacttaaggggaatcacatttagtccaccaccatcaggccaaagtcgaaaaaacaccaacaagacctctggacaagtaattacccaagataaccatcagaacaagagacacagaccttgcgctctgttccactcctgcatatctcttataccaagtttctctttaaaaaccctgtaataaaatttaaaacttaagatgatactttagatggatggttcaccatcttctggtttgctggctctccaattaaagcttgcttctcctcccaccaaacgttgactctcatgtttggcttttgagtggccttgatagtttctcttgctgtgcagaaactttttaattaggtcccacttgtcaatttttgttttgttgcaattactttgggtgacttagctataaattatttgccaaggctgatattgacaaagatatttcattcctaggatttcttctaggatttttatagtttgaggccttacatttaaatatttaatccatcttgagtgaatttcttttaatgatgataggtagtggtccagtttcattcttctggaaacccacagccaacattacactgaacaggcaaaagcactccccttgagaactggaacaagacaaggatgtccactgtcaccactcccattcaacatagtgatggaagtcctagtcagagcaatcaggcaggagaaaaataaaatgcattcaaatagcaaaggaagatgtcaaactatctctctttgctgacgatatgattctatacttagaaaaccctaattactctgctaacaggctcctagaagtgataaacaacttcagtaaagtttcaagatacaaaatcaatgcacaaaaattaatagcatttctatacaccaattaacattcaagctgagaaccaaatcaataatgcaatcccatttataatggccacaataataataaaatacctaggaatacagctaaccaaggaggtgaaaatcctctacaaaaagaagtacaaaacactgctgaaataaatcagagatgacacacataaatggaaaaacatcatgctcgtggattggaggaaatcaatattgtcaaaacagccatactgtgcaaagcaaggtacattttcaacgttatttctatgaaactactaacaccatttttgacaaatagaaaaaaaaaactattctaaaattaatatggaaccagaaaaagagcctgaatagccaaaacagtactaagaagaagaagaaaaaactggaggcatcacattacctgatagcaaactatactaaaaggctacagtaaccaaaacaacatggtactggtacaaaaaacagacacatagactaattgaacagaacagggaacccagaaataaagctgcacacatacaaccatctgatctttgacaaagtcaacaaaaataagcaatggagaaagcacttcctattcagtaaatagtgctgggataaccggctagctatatgcagaagaatgatactggacccctacctatcaccattattctgtatcttttaaatcttgtgttcttaggttgttacatattttgcctgttttgctttgaagtgtttcagctttctgtacttctgtatgcgttctcttcattaagtctaaaatttgcttaagggttaggagtacataaacccagataatttatagtactactttgttatgtcttttaactaatctaaaacaaggctgctccatcaaccggtaatactcatgctaaacaaattaaagaataaatagaaagtggtaagctcaggtatttttcttggagcttgttcataatggaatagaaatatatattggcaagtattctgaggagtcaatattgcaaaatggaaaaaagcacagatttcaaagtcagtgatttt

SEQ ID NO: 9597 - DNA, 2875 bp, artificial
  synthetic oligonucleotide
aagcttatggggatggaaaatgtcaaatgtaagagagttatttaatagcattttttgttttgttttgtaaaactaacaaactttaggaagttttagaaaatttgaaagtggaaatatgcataagcaaataagatagaacacaggtagtcaatatcaattaatattttacatgctcttgcagttttttctatgaattgttttatgtaattaagataatactgtatatacatttttgcatcctactagttgtttttgaagttatataaatggtatttatctgaattattaaaaaatccttttagatattacttttaatggtatcaaagattctattgaatatatgtattctcgtttatttaacaaatcaggagttattggtcattagagttggttacaatatctacacatttacaagtttcctattattgtactctccagtatctctcaccccttctcctgagattgcttacatacctactctagccacatccttcccaaagattctgtcatgttctggcaaggccttaagcttcaggccatagttgaatggttaaactgttagcatctgacctcaaacttaattattttctcccctagaaagtttttggatttgcagtctaagagagcaccctccctctatggttaaatgtataaattaagtccctggaagctgtgtgaaactataaatagtgtcacgtggcaagaagtgatttgtgatgaaagtcaattaaacagctattcaaagaaaaatagttctgagagacaaatttgaattcctgctccagttgctcctgaagtaaagtgacccctatagattccacagcttggcttttcaatccttctttgaatcaataaactagtaatctcttcatattaaaagctagttttagttgagtttctgaaactttcaacaaaaggagcctgaatttaaacactgtattgaacatctttgagcataaaacatggtccaaatttgaaattaatatcttacaatagaggagtatccaaaaattctggaaacttttgtatattttaaagtctctaaataaggggatttatatatcacaatgttgaaagaaactgaaggagacagtcttgataagacatagagttttagcttattgctaaagaaaattcattgtgagaaaggtggacaaggaattacaataaggtaaagaagcaattaaatctcatcatgaaaaaaatctggaacattattaaagtttctgtggaaaaggacatatattataaggaatgcacagaaaccgcagatactcaacatttggtatgagttctactaatatcaactggggctagataacatttatgagttttgaggaaaacagattgtgtaacattatgttttcagaatggcatgaaaataatgcaacagtgtctagtatggccaagtctctgttacttaaggatttttcatcacttaatcacaaagcagacataaagaaacttgttttagtgtatcatcaatgacaatttttcatcaaaacttttaataaagttgcattctatcaatattattgtgtaataactgacagtggattaataaccgaatatataaggagttcaagcaactccatagaaaaaaatccaattaaaatggacacaatatttaaatagatatttctccaaaaaagacatacaaatggcaaacaggcatatgaaaaggtgctcaacatcattggtcattggaggaatgcagatcaaaactacaatgagatatcatctcacctcaattaaaacggcttatatccaaaagacaggcaataacaaatgttggtgaggttgtggagaaaagagaatcctcatgctctgttggtgggaatgtaaattagtgtaaccactatggataacagtttggagtttcctcaaaaatctaaaaatagaactaccatacaatccagcaatcccactgctgggtatgtaaccaaaagaaaggaaatcagtatatcaaagagatatctacactctcatgtttgttgcagcactgttcacaatagccaagatttggaagcagtctaaatgtccatcaacaaatgattgattggatttaaaaaatatggtacatatacacaatggagtactatgcagccatacaaaagaatgagatcctgtcattagcaacatgggtagaactggaggttattaggttaaaaaagtcagacacagaaagagaaaatttgcatattctcattcatttgtgggtgctaaaaattgaagcaattgaacccatggagtgagagggtagaaggatgtttatgagagcctggaaagggtagtgagggttgggagggaagtggggatggttaatgggcagaaaaatgcatgtaattagaaagaataaagaagagctagtatttgatagcctaacagggtgattatggtatgtaataatttaattgtccattttttaaataaataaaaatgtctgtaacccaaaagataaatccttgaggggatggatgccccactttccatgatgtggttattgtttgtttcatatctgtatcagagtatctaaagaaccccataaatgtatacacctactatgtacccacaaaattggaggaaaaaataaataaataaataaataaataaaaattagaaggatttttagtcttgtaacgagtttttcagcatgatatgctctggctcagagaatatctttgagatggtgtagatcaaaacagatattaatcaaattgatcactcatttcctttaccatttgattgttttgtgtaactttatactttttcccaacgatgaaatctatcttcaaaggatgaaggttcgttacatttgagtatatataaagaaagactaaaatgtctaaagtctcgagaaaagcttttcaaatat

SEQ ID NO: 9598 - DNA, 218 bp, artificial
  synthetic oligonucleotide
atggaattcaacaaaaggataagaaacaatttcagaagtctgtaaatcaacaaaagcataaaacaaatgtagaggtgtttatccgtggaaaaacgaccaaattttggctaagaacagggggaatatgtggcattcttgcttggggctcttcctattaagctctaacagctcagcttgttcagtagttataccaggaccttactccgagatcaaagttg

SEQ ID NO: 9599 - DNA, 1040 bp, artificial
  synthetic oligonucleotide
aaattaagtacagaaataggccggctataaaaggtcaattgattttttatagagattcaaaggcaggtcaatggggaaaggatagtcttttcaaaaacaaatatactggaacatttaaatattcatattcgaaaacaagaatgaacaaaagaaagaagtctcaatcaacaccatgcatcatagacaaaatttaactcaaaatgatcataggactaactgcaagtgctaaaactataaacttcataaaaggaaagatagtgtaaatctttatggccttggactaggcaatggtgtcttagatacaatagcaaaaatatcatctgtaaaataacactgataaattggagtttattaaagttaggaacttatgttctcaggtaagaaaaagaaatgacaagccactgacttgggcaaacatttttatttcacataatacttaatttgtatccaaaatatgtaaaataatctcaaaattcaataataacaaaataaataatacaataaataacagacaaaatatttaaacagattcagcaccaaagaagatgtaataagcacataaaaaatgaacaattaaccattgaagatgtacaaatcaagaccacacacttattcgaacaataaaaatataaaaatgtgtgctgtgtgctcatactaagtgttggtgaggatgtggaggacctggaactctcatatatactgctggtgaaaaagtgaaattatacaactattttgggtaagagttccatagtttcctagaaagttaaatatcctaaaaagttaaatatatatctgtcttatgatccagccgttctactcctaggttttttactcaagagaaatgaaaatgaatgtctacacaaagacttgtacatgaatattcatagaagctttttgtataatacccgaaggctggaagcaaaccaaatgtccgtcaaagggggattggataaataattgttgatccatccacacatgtaatattactcatcagtaaaaaggaatgcattattaatacacacatcaacatcgaagaatct

SEQ ID NO: 9600 - DNA, 1588 bp, artificial
  synthetic oligonucleotide
gattttgttctttatagcatatctgaagtcggaccatccagcttccatccttagcttgccattggaggaaagcccattgcttcaagaattagcctaatccattgcctttgactcaaattatgaggtattttttctctccaccaagtcaaactacagctttctcgctctgtatcttccactgactcattctatttaaaaattttggagcaacaaagaacaagcctcattgtaaaccattttatatgagaatttacttcaatgtctacattttaaataaacataatgttaaaccgactgtgagtagccaccagagtccgttttcagcaaagatgaataaccctctccagtctttattttttctatgattaattttcaaagtatggaaagataccttttctcaatgatcttcttagagaatagaaagagtttgaggccaggcgcagtggctcatgcctgcaatcccagcactttgggaggccgaggcaggtggatcacaaggtcaggagttcgagaccagcctggccaatatggtgaagcccatttctactaaaaatacaaaaattagccgggtgcggtggtgtgcacctgtaatcccagctactcgggaggctgaggcaggagaatcgcttgaacccgggaggtggagattgtagtgaggtgagatcacaccactgcactctagcctgggtgatggaatgagactctgtcaaaaaaaaaaaaaaaaaggaaaggaaaggaaagaaaatttgagtcaagtgagagttaaatattcaggcagtcaaactaggaaaaatccagtagttttaaatcctaggctattagcactttctgattattgactgggttataagtggtgatcattattctgtcataaacaaatctaaggatcaaacaataccactgagattaggaaatgggaaattgctcacagtgatcattatttcatcatgattaaccaaaaagtaatgggtttggttttaaagtaacacttgggttttttctgcagtaatttgctacttaattacaaggattactgtgaaagcatacctatgagttatggcttcagcctactggaaatccttacacacatccatatactaagaaccctatggttaccatgaagcatcctgctaagatctgctgatagcattttctgatagacctctctgggtcatgccaccaatttcatgctttgcataaatctcatgttgcttaaacattctgaataatcagaataaaatgagaaatctattttcattaattaaacatattacctaaacgttgcattaaaaatgcagtatattttatctctttttcttttataagacataaggtaagagaattaaaaggaggcaattggcatgtgggaatgaatttccccactgaatgattttaaataaataaacctttgggatcaattttcatctactgcaggaaaaagtattgacaaaagaagataaatgacaattgcacacacaccccaaactatattcaatgatgaaattttcaatatttctcaatgggtggtgtaaacaatctctatagtcacctgtacaatagtcctcaaagtcattaatgtctgatttct

SEQ ID NO: 9601 - DNA, 233 bp, artificial
  synthetic oligonucleotide
aaaagcaactgttaaaaatgaaacgaataagcttaattatatatcaggttattggcataaccacaaaaataattatttcaagagacttttacacacagtaggttggttatacatccccagtgggatgcaccctaaggacaaaacatttttaaaaagtaacagcagaggatacttaaattatatttgtaaacactttgttagcaataatatatttatattattgttctgaaagt

SEQ ID NO: 9602 - DNA, 910 bp, artificial
  synthetic oligonucleotide
agaagaaccaatgtttcagaccaagtgtaaaggcagaaaggactaatgtctgggctcaaacaataaggtaggaggatttaccaataaatcagcctttttcttaattattcaggtgttcaaccaattggatgaggtaaacacacacacacacacacacacacagacactcacacacaaacacacatacattagggagagcaatctgctttattcagcctaccgattcaaatgttaatctcatccagaaacaccctcacagatacaacaaataatgttttaccaaatgtttgggcaccacatggcccaatcaagtcaacacataaaatcagccatcatactctccctgactgattttctgctgtttgacttttaagggagccctgtgatattgtctccttaaaggtattatatatatgatatgagctagcttcatttatagttggagtctatggcagcctaaatgctgtggtataatgtggcatcaggatgtcccctcaaactaaagatattccccaatatgtgtgtatgtatgtgtgtgtgaacatcatctaccggtttctgaaactcatttcaccattagagttattgtgagataatgcaatatgggcgacatgcaccaaaatgcaaatatcaaatatctatggaaggcaaacacactaactccttatcaccattgacatgaagtagtttgtataaattgtaaggtgatttaaaagcccctttgtaatgtgaaatgggaaggggaaatttggaaataaaaagatctaggttgtgagcacagctacaggttgtatgtgtgtatacgtgttttaggaattgatcctgaggtactttaagggcaactgagggcactcagcaataggcaagagatacatgaaatatagaaatgacatccaaaggataagtaaaa

SEQ ID NO: 9603 - DNA, 768 bp, artificial
  synthetic oligonucleotide
aatgaagaaggaagagagggaggaagagaaggaagaaaactggttagttatacacgaaagtaacaaatggacttgtgggtgattttcattttcttatttttttatacatgtcatctaaattttcaacatgaacatgtataattttctaaattaataaacattattttatagaatagttttagatttatagcaaagtaaagcagaaagaaccaagaaatcccgcgcagcccttgccttcgcacacaaacctcccctaccaacaacatcctccaccagaaaggtatacttgttaaaatcaattaaactatattgacacatcaatattagccaaagtccatggtttacattaaggttcactcttgttgttgtacattctatgggtttggaccaatatatactgacatgtgcccaccattaaagtatcattagaatagtttcactgctctaaaaacacctctgtgctctgcctattcatccctccccaacccccaccaatctctggaaaccattcatctttggtctacagtttttccttttccagaattgggttggaattatgcaggatgtagcactttcagattggcttctttcactaagtggaaagatatgcatgtaactttccttcatgtcttttcatgtattagtagatcatctccttttagtgctgaacaatattccattgttcgaatgtaccacagtttatccattcatctgcagaaagacactttgattgcttccaaacattggcaattaagattgtcaataaca

SEQ ID NO: 9604 - DNA, 1222 bp, artificial
  synthetic oligonucleotide
taacattttaagcttgtactaggctggaggagatggcacttgtgtgtaacggggtgctgcttgacacacctccagtcacacagtggaaatggctgcctactttaccctgaacatagcacagaggaggtgccttggctgtttagaggatggaagcaaccagctaacaaaaaaaaattgcttaatttacaaataacctattagcattgtcaagaatccactcacaggcaggtgtccatccctaagaaggctgtgtattttacctatgattcttgctttgtcttttgcacttctacctttcttaactgagtctgaggcaaagtgaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagt

SEQ ID NO: 9605 - DNA, 2064 bp, artificial
  synthetic oligonucleotide
cactgccactgcttagtttggccgcatcacttcttagactgtgtatctctttccagtgcatcacgcagatcgacatctttctaaaatgtcaatctgaatatgtagcttccatggctctctattgcctatgggatgccaaaatccttcctcagcactgcatacaagggcactctatgattgggctcttgcttatgtctccagcacaaacttctccagttctttgttttagtatttcaaattatttatttattttttaagaggtagcgtcttgctctgttgcccaggctggagtacagtggtgtgatcatacctcactgcaaccttgaacacatgggctcaagtgatcttcctgcctcagccccagttattatatatatatatatatatatatatatatattttttttttttttttaatttgagacagggtctcacttccattggccaggttggagtgcagtggcaagatcacagctcactgcagcctcgatttcctgggctcaggtcattctcccacctcagcctctcgagttatctgggactactggcatgcaccaccccacctggctaactttttgtatttttagtagagatggggtttcgccatgttgcccaggcttcagttcttttagtagaaatccctgccctccattttctaggtgttagctaaattaactacttgtagttccaggaggagatgggctctctgttttgatttcccattcctttgttcatactcttccctgggcaaagctatcttttgtttgcctaatgaagactatgtcactttaatgctttttaaaattttatttttaaaataattttaatagagatgggaggtctcaccatgttgcccaggctgatcttaaactcctgggctcagacgatcctcctgcctcggcctctcaaagtgctaggattacaggcgtgagccactgtgcctagttcatcatttgagctcttaccatccttttctgactcccgactccagaatccttttctgactcttgcccacattctcctttgtgtgcacattctacttttgtcaatcttctataatagcacctacaacacttgattgaatttctttgatcccgactatcttttcttaataggttgcaagctctttaaggtcaagagttgtgaattacagtcctccctctgtatccatgggttcctcattcttggattcagccaactgtcgatcaaaaatatttgaaaaaggccgggcgtggttgctcacgcctgtaatcctagcactttgggaggccgaggcaggtggatcacgaggtcaagagatcaagactgtcctggccaacctggtgaaaaccctgtctctactataaatacaaaaattagctgggcatggtggtgcatgcctgtagtcccagctactcagggggctgagacagaagaatcgcttgaacccaggaggcggagattgcagtgagccgagattgcgccactgcactccagcctgggcgacagagcgagacactgtctcaaaaacaaaagcaaaagcaaaaacaaaaaaaaacaacaaaaaagaaaataatacaaattaaaaaaccaatacagtagaacaattgtattgtgtgtgtatatatatatgtagtatttacattgtattaggtattataagtaatatagagatgatttaaaatatgtgggagaatgtgtgtaggttatatgcaaatactgtgccattttatattagggacttgaacattttgatattctggggggatcctggaaccaacctcccttggatatggaaggatgactatattcatttttctatgaccagcccatagaatactgtgtggctggctggcagaaggcactcagtaaatactgttgaatgaagaacaattttaatcagaattatctggatagccactgttcaatgtggtagccactagtcacatgtggccatttacatttaaatttgaatgagttaaaattaaaagaaataaaaaattcagttcctcagttgcactagccacatttcaagtgctcagtagctacatgtgactaccatgctagattaacacaggttatagaa

SEQ ID NO: 9606 - DNA, 2193 bp, artificial
  synthetic oligonucleotide
gatattaatgcttaatgcctatatttatcaagtcacagaggttgtaaagttgtggtattttaattctataatatttcctactcattagttgaaatagttttatatagaacaattatcctcatctactattgggttaccaacagtacagttcatatgattcaaacatattagatgggtttctatcctttgtaatttttattagtttggctaagctggaattacattttccagaatccccttccctccgtggcaccaggtgagagttggccaaaagagaaatttgtgcaagatttggaagacagaaatgaagtagctatttcactctctgagggtcgttgttacatgcagcgagaactagacatagaggtgcctgctgattccagcttattcttgcttttctccattcagaattcagctcttcttcccaattgccagtaagagtgagtaaacccaggctagtattgcaggttgccagataaaatgcaggacacagagttaaatttgaattttagatacactatatttattagtataagtatggcccatgctctatatacacatatgtgtatatatatatatgttttacatatgtgtggttttacgcatatttcacacttatataatttacatacatattttacacacattgtacatatacacttatagtatgtgtgtacatgcatgcatgtgcaaaatctggctaccctaccctagacccaccactagatgcagagggaaacagctttccagggacttctctatcagcaatcctttccattcccactctggtaactggatacgtctggctgtttagtgactttcctctgatcttccaactctctctggtccttactttcccagcctctttcccaattatgtatgtttgacccttgaataacacatgtctgaaatgtgtgggtccacttatatgtggataattttcggccaaacacagggatgtcaaacacacttatacagagggctgacttttcatgtatgtgggttttacagggctgactgtgaaacttgagtatatatggattttggcatacactggggatcctgaaactaattccatgcatatacccagggatgactgtagttttattactataacaaatatcttcttccatcatactcataatggttcagttttcctggctaaatcctcactaatacaatcctgcaaatacaaccaaggctttcatgccttgtccataaggtagactctaaaatttgaaaaccaagtaaaacagcatatatgtttgcatgattattcaattctgagtcatgtaatgttgggtcaagaaatgccaagacagtcagtgtactaaaattacattacatcctctatggatcctagtgttttttttttgtttgtttgtttttctgagacaatgtgtcactctgttacccaggctggagtgcagatcaaggctcactgcagcctctatctcccaggctcaagtggtctttctatcttagcctcctgagtatctgggaccacaagcatgcatcacaaagccaggctaatttttctattttttgtagagatggggatttgccatgtgatatggtttggctccgtgtccccacccaaatctcatgttaggttgtgatcctcatgttggagaagcagcctggtgggaggtgattggatcatggaggtggacttcccccttgctgttctcatagtgagtgagttctcacaagatctggcagtttaaagatctgtggcacttcccccttggttctctctctcctgccagtcatgtgaagatgtacttgcttccccctttgcccccctccatgattgtatgttttctgaggcctccccaaccatgcctcctttacagcctgtgagtcaatgaaactttttttcttcgtaaattacccagtctcaggtagttctttatagcagcatgggaacggactaatacaccatgttgcccaggctggttttgaattcctgggttccagtgatcctcctacctcagacttccaaagtgctgggattataagagtgagcctctgcacctggcctggatcctagtcttaaggtgaaatggatgttctctatgtgggtgttttatcgtattttcttaaatccatcaatcaaataaaacctgttctatttcagtttgcttgatgtttggatcacgattttcctgcacatttaaaagcttttcctgg

SEQ ID NO: 9607 - DNA, 1335 bp, artificial
  synthetic oligonucleotide
gagctcagggatggtgggttagatctgcctccagtccaagctaaagatgtcttcaagtttccctgtaagatcccgcccagctcaccaaaatcaacctttgtcaggggttttctgatcctaactagtaataaagagtgtgcactggactgctgtgtcttctgtgtagtgtgtatctcagggcaaattttctcagaggtggaagcttaaatcttcatctttccttcatcccactgaagttcaatctcatttactaccggaggggccttcctcttatgaggaattacccaagaattgggggcacttctgtaggaccttcaatccatcatgattgtcctttctatcctcacagtccaagtccacatggtcccgtgaaggttagcatatcttctgctccagggtggtggggcaggaggggtgagttggggagggtgcttctacctaggcttggagctctgatgcctggaagccagccttctgtgtaccaagaagccatttccctgagatcctgtctccctgaggtcccctaatgtcccatgaacagaaactttcctcctgcatttctgccttccaagtcactgtcccctctcccctatgcataatcctatcaagttgtttaggattctggaaaacagccaggctgtagcctgtctgctcacaagacaaatgttccctgaggtgaaggggagtggaggctggctacctgcttggtatgggcacaggaatggggacagagaacaaaagtgaccttgccccgccagcattctcacttccctcagagtcatgattactgggaggtccttggttactttggaggggagcacttcagaggaagggatccattagggatgtcagacccaaagctaggttttctggattgggggctggttttatgatactcatgtgggctgatagctccttggaattttgggaagatgggatacagatgagacttggacatgtttcagcataatccattttcgtataccagcaggtcattctagatttcactatagttgtttcttttatggcttcaaaatggactctgttgttaattggcatgcttttaggcctttataaaaacagactcaccctgtgtatagcttttatatattttaatatgattacacagtctttcaggggcaacctttttcaaaacaatatgaatcattgaggctgtcagatcactactctcttccaggctgcatacatgcaagaaaaggcagcaggtttctgtggcataaacctgggctttggagacagagaaaacgagttcaactacttgatctattattcagtagctgtgtgaccccaaagaatttactgaatgtctctgag

SEQ ID NO: 9608 - DNA, 1593 bp, artificial
  synthetic oligonucleotide
aagaaacagtagaaaaggctttgaggaaactatgtgataggtgcttcataaatgtaccgagcatattttatatgtacatattttcctctcatttgccttcccttaccaaccaatcaaccaaccaacacataaattccccaaacaacaattttgcaacctctttgctggtgaagcttaaggggtatttaattttcactgagggtaaaaatcaaattggaaaccccaggcatgaaaaagagaataatatttgtccatcatttggggaggtttcccctcccataatgcttattgttataacccagggatagtgatgatgctgtagatatattactgcttgtcagaatgagtgaaaggaggtgacacattcccagtatatattttaagctttattctttggagatgggcatgtgagtgatttcagatcacataaagccatctggggctagcaagatctgcagattcaatttactttccaattttgatattgctgtgcccagatctccaaaacttggtaaccaatgttgtgggcaaaatttgttccaacggtcatgttcattgatgtgttcactgacagcattttcattagcacttaaacaatcaaaggtacagtctctggatgagaaaagatttaaagatttaaactgtactaagaaaaccacttccaggtttaaaaattttcaaccggaattcatttttgttttcaaagcaagtaaaaatacagagatctctgatattaccacaaggttaggccgtgatgcaaggcaggtggaggtggaagtgggaagaaaacacacaatagcttgagtcccctcaatttaactttgaatttaaaaatccccctgcaccaaggaaaacactggcctcagatgcccagacagcatgtttagcttggagcacatttttacatttgggagaaaataaataaatccttgtaaattagtgcatataatgaaagcactgacagaccataacctggaagtgtgaatggtgctgtctccattcatcagcattaagccctaacaagctctttctatggagagacctgctcataaataaagtgcatcttgtaaaaaaattattcacaacatcccatgcaaagtaggggatattatataatatctgaactgcaggctcttttctctgtgaagcagtgctctgtatgaaacagctgcaaattataggcaaaattatttgacttcttcccttgtcttattatcctccaatgaataaatactttaattctttagatgacaattgcctaaagctggggcagcctggatagttacttataaatttatcacctgtgaggggaaaagatgctactgatcaatactgaaggaacaggggcatcctgatgtaatcactgagagtccagatgtggtgcttaatagcctggaaatagtagctaaatcccaaattagataacagtgaagatttgagtttttggctgtgtagaatgccaatttcaaatgttggcagaaggcatctctgtacttaattttttaaaattacagctgttgaggccacctacatttttattatttctatataaaaaatgaaacatctttcagaatataagctttggaaagcagt

SEQ ID NO: 9609 - DNA, 534 bp, artificial
  synthetic oligonucleotide
tatactggctcatgtataacatttgtgagtgcctttgtgtacctgggcactgccctcctctctctgggcagacccaccattccattatataggcaaggctaagggatcaccctgatcctctgttggtattcatttctttgttcggtcattcaacaaatatgcaatatttcatgggtacctcttgttgacaggcagtttgtggggcactggggatatgaggttgaacaagacagcatccctccccccagtggaggttatattcaagtgggaagaacaaatataaaagtaaaacaaataacacacacacacacacaaacacacacacacacacacaaacacaaattgtaataaaggttatgatgggagaatgctgagcattatgagagagtgtaaccaggaaatttatgttggactgtggaggcaaggaaaagcctctttaccaagaaagggtttacctttataggggagggcattctaggcagagagagtggcatgtgtggaaggccttgagacttggtagctattgagagattt

SEQ ID NO: 9610 - DNA, 1896 bp, artificial
  synthetic oligonucleotide
acatgtataaactcaaattaataaaatagatgccttgataagcatgctttcatgaatggataaagtcaatgggaaataaatagcaacatttccacacaaacaccaagttcattcattggaaataacttgtttcctcaaattaacatgcttttggaaaagccatttacactcttatcttaactcaaaccaactcctcaaggatctatggaaatgctgaaggcaggccaggcatggttgtcatcaattaaaatctgtggaatccacattggtaaaatcttaccataggtgataaataaggacccaaattatatactccttattgaaaatattagtaggagtcaaagtaagacatacagaacagagcagggaaaagttgttcaagtttacatattgcatacacacatgatccaaaggagaaagcaaagcatacttggaaaataatccattgcattcaactagattgtttctgaattgctgttttaatacttcctcatatgtaaaatggaaataatagaatttgtttcacagagtggtcataaggatgaaatgggataaagatatgaaaagtgtgtttggaaattttgaaatgctaatccaataataacagtgaacattcatattcttcctacatgttaaaaacactgttctaaatccttatatactagtttcatcccatttttgagtcactgccctgtggtgggatgcttggaccctaccacgaggtgttagagaagggcccagcacaggcccagttgtgaaaaccatttataaatgttactttcagtagtatccctctccaaaggggcaaaacccaatgaacacaatgaaggcaaaagtaaaaatatacaccaatgcccccttactaaggaatgacacagtgtaaatataggtttacagaagagaatgaacatttttttttcatttgaaagtgttatttatgattgatgacatggataaagtgtgatgctaaagccaagcatgaacacctggaggaagagaccaaggccaactgctaggcaacatctgaaagttatgacaatacctaaactatactgagttaattatgagagccatgtaaaacatggtagatttgtagaaagtcatgaagccaaatccaacccaacctgatttcagtctctcctcccaggttaaataaatgttttctcatcctacctggaatcctgttttatccttctccctagctcccccttcacctcctcttcaccaccaacattttcacatgaaattttcaagaagaaaacaaacaaataagctgccactgtattctctgacaggttcattgagcaggcttgtatgttgtttgtcagagaagcagggttccattttgtgggggtagggtgccagggatggggtgaagtaaaaataatttgtgatcaaatatttgaaaacacttgccttgagtagacccagcttgagcctccatgtcacaacaaacaggagagaatttgaaacctgtaacagtaaacatttcactagttaagccttgtccaagtcatctgcaattcctcaaacttcaacccttacccttcatctagtggtgcttaaaaaaaacccagctttattgcaatataattcacatatgtaatattcatccttttaaagcatacaattcagtggtttttagtatttttgcagagttgcacaaccatcacatctatctaagtctagaatattttcatcaccccaaaagatacctcataacaagagacttgcaaaggtagaagaatagcagagcccagtggggaaacttctttcattttaatgtttcaacccagtgaatatgtccagagtgagatgaaggagaagatgtcttgccaatataagagatcacctaccaccccatttcatataattttgatcattgtttttcccaac

SEQ ID NO: 9611 - DNA, 3746 bp, artificial
  synthetic oligonucleotide
tccttggggtagaaggttgggggtggcgggcgggagcgagaaggaatggggtgggagccaggagaaacgcacctacctattccaagcgcaagtttcggcggcgtccccaggtgctgttcccccgccccctcgccaggtgctcggctccgccgggcgctgccagtgcccgggacttagggcgtctcggccgactcctgcgggaaacgactgtaaatccacattactgttcgagctgccgctcgggcccccgcattgctctcctccggctgctggcagcggtgctctaaaccggcggccgccggaggcaggaaccgaacctagctactattgcaccagcggacgaccgctgccagaagggtgcttgcgcccagggtcctatgtgtgtgcgagagagtgtgaatacgtgtgtgtgtgtgagtgaaagagagtgttcgtgtgtgagagagcagaaggggtgagctcagcccccggggcactcggaggtgaactccgggctgagccgaagctcgccgcgctcccgggtgctgggcgtctgctcggctgatggctgggctgatgttgccgtggccgccgccgccgcgctctaaggctggtcgcggtggtgcaaaaaatgtttctccgctactcgagaccaaaaaacctgccctgtctactgagcatgcccggtttgacagcttcacagccgaggtttttttttttttctccttttccccaagactccaggttttagccgcagctgagatgggaggtggagggaggtggggggaggaggagagggagaggaggaggaggagaaagaggagaagggcttaaggagcaagtatcgggcagaggaagggaagtcgcaatgagaaagatcagggtgttatagggtggagaggggaaggagaaagctggatatggaagcagaggaaggaaatatggatcaacaaaatttagatttcctactacagtggatagatgcctggccaggtgactcactcgatgttttttttttttttttttttttaattactttctcctgagggtgaggggtggggtggggggttcggatgagtatttgtcaaccccaggatcagcctgggacagtgttacctagtcatgacatacacaaacatcgcgtgcacacacacgcgcgcgcacacgagcgcacacacaggagcacaatcactgcttctatgttcaaagcctcaggactgacttagaatgcgaagtcttttgccagtataactttggcaaaaaaaaaaaaaaaagggcggggggagagaaattgtttggtttccttttcttattctcctctcccccgccttccagaaaagccaaaagcccgtgaatgcggtgcataagcgacccacaagctctcgtgcgtctgtcggtgagagtgcaccgccgactgcgtcctgctgacagtgtgaccccagagcgccaaggccggccggccacatgcagcctactggcggcgcatcagatcagcagtaacgacgtccacctgaaggtggttgggggaagaggggagcgctaagggatcctgccctgcctggccgcccaggttcctgggctccctaaacggctccgcccctcacccagcctggcaccagggcacgtactcgggcgaacccagcgcgctgccccaagccctggatccctccctccctcccaaccctcctcagcttcctcgaaaaagcggagaagcggaatctgcacgcccagaaactcgcgtcagaagccttagtagtccgactgggcatgctcgggacttggggcgcttcgcatggaggcactctccagcggctaacatctgtccgactgggccagatgtgagtctgaagtaggaggcttggatgcacgctagagcaggctctggttccgggaggggtggcggcgacgcccacagcagtcttctttccggcttcccacagagagcaagaccgtgggagataccaagtgccgagccaggggagctgcacaaactggagaaataggagtctagcggattcccaggcctcctgccccgcggtgccaccccagccgtaggcaggtagggggcgcgcagagcagctagggagcaccgcgtgtgctcccaagggactgctgacctctaggtaaagaaaagagagcgtgaagagtcgaacattctttgggcgaaggacgtttactgatttttttttttttaagtaaagaaagaagggcgtgtgtgaatgcgtatatgtgcacgcacgttttaaattttcctccgcaagaacagggacaggagagcgagaagctattgccgagttgggaacccgctagaggttacaataaggcaggcttggagtcgtggctggtgctagttaccgggaagagttcctcttggcgcggtgggcgaacaccaaagcttccaactgttcccttccctgggtggcggcagctgcccaaggtcggcttccgggctggtctctgtgctcctgagcagggggaccagattcagtttcagaaagagaggtagtacagagtgacgccagggggagttctctgaaccgtgtgttcccattttcccagcttttgatataggtatttgcaaagagggagcattgtaagaccatcacaccaccaaggggaggaaatacaaagagctgaacactctagggggaagaatcagggaatcaagagcacgtttattcccatcgtcccttcccaacaaggtcttcagcttcaggcaggaatcatttggatccctgcggctcaacaccctcccactcccgtcccgccccaccgccctgccaacaaagaaacaaaagatgacaaccaggctctgtaggggcatagcaactgcttctatcaccggctctctgttgggctgttgagaaagcagtagtgaaaggatgggtataaaacctgtgtcttgccacaaatatgtaaacgaaaccttcctaaaacccactaccctcctacaaaacaaaaacaagttatttgtataaacatatatagatttaagtatcctaaataaagattccacattatgaactgcccaaaccctgaactgtggaaggaagactttcaggatacctcctcaatccttaccaaagagttctggaaggagaaaaaaaagaaacatctggccagtcacttctccaatgactggaaatactctgggtgtttccgtaaccagcgattaagaaaagaactccccataacaaaaagggaattctggccaaatgggacatggacaaaccctaatgaccaaggaaatggaatatgaatttaaaagcatgattatctcactctcattcttgctgttcctttgttactcttcttgaagatactggcagaaagggagagttgatacttagggatttcatgaaaggaggccgagtttgtttctctcctggcaattcagcagtccctgtaatcatttttttttagaaattctctaccacctcctctttatgctgtattttctctagcattcttccctctcatttccttactggtctcctgtggctccctggtgtccttaattcatttggtctgcacctgtctccctttagttccttcaaaacattgtttccagtcctaattccgaagtacagagggctctgtcacttttctctgtttcctaagaactgatttgctgcttctagacgcctatatcctgatattgtaggtggatttcctaaggcatttattcaactttagagattccccagacacatttaagcaacatgaaattgcagaattttcaagtagttttgctcatgggaccaaga

SEQ ID NO: 9612 - DNA, 728 bp, artificial
  synthetic oligonucleotide
tcaaaaaatacatatatatggacatgtacaaatttatagtttctcactagtgaatggcaaagcttgttaatatccatgattcatttaaaaaaacagtattcatttggcagagaggaacatagtgctaaagagtcttgagttccgttctatcgagggcaattaacttcactcattatttccatggtttaaccaattaagtgagtcagttacagaccaattggtacacatatcacccattgaatataacgaaaaacattgcaagataaatcagctttttagtttttatggtaatttcatctcttggtgctccctgttctataaagaagagaaaacatccttgattttggaggaagtgaaaatgtaactagcaacacattaatttgattccagcagctaaaatttcagttgaatgcactacaatttctttataattgcaagcattgtggtgtggctaggctaccatgcctttttctctgactgatcatcttcctatactgtaatcagattctaaggatcagtctgtagctaaaataagagtgatttttattgttgatttcatataattaatatgtgagggtagtacattggagcttttcattataaacactatggtaattgatcattccaactattggtttgaataacttaaatgtaacctgtaatttccacaacctgaaatcaagaaggtacatttatttctaattaaatggatgcaaaaataaaaccta

SEQ ID NO: 9613 - DNA, 418 bp, artificial
  synthetic oligonucleotide
cagtgcctgccaagctgctgggttttactatgattgtgagatggcagttttcaatagtagtgctgatctgggaaggggcagattagactagagtaagttaaaataccatgaaacttgctgttcttactgttttattgaatatatatgacaagaattgctataagctgttggtaaattcccagagttgtgaaaaagttgttttgacaacattttgtcggtgttctcatttctttatggaggtgatttcattggaggtttgtgcactgtaattttcactaatatcaccagactatatgatctttaccttttagacctgttagtatatgcaactgagacaactggcaatacattgcataagaatgttttgtggccttttaaatttgcctaatattcttttgacatgagtatgaaatgcaga

SEQ ID NO: 9614 - DNA, 1187 bp, artificial
  synthetic oligonucleotide
atcttttaacttataagtttcattttcaaaaagagatgtacaaagtaatgtctgcatagctaatgcttcagattcagcttctgtcctggaaagttttgactttgataaatacgttctcagaaagacaaatgaaaaaagaaagcatatatttaagtattaagaacttaagtctgccacttaattgctaagatgatgaacacattttatttatttttctgcaacacatcacatactggatccagaattatccatgtatacagtaataaaaaatcaacacctactctgagcacaactgccacaactggcttttcactgtaaatagctacctgaatttaaagagatgtgtaccccatatacccccaaaaatacctccctgattgcactaccacatatatagaccagaattgagtagttctgaaaatctgtagcatagaaaagcaggccataatacagcggctttaaataagaacacggagggcctgaggatagtaaagttttactgaataaccaaaaatgttgattaatagtatgaacaacattgtaagatttctaactaacagaacatatttttaaagcattttacacatcaacactatacaaacaacagacattgagtttccaacatccaaatgaatcacgccctagaatggtgtgtgccacactctagaatggtggcaatctagaacctgaactgcattttgtaattagagtaaggctataaatgatgggtagttcctcaaaacaaccccaaagatgctttgtagctcacatttccccaaaacaccacacatctaacatgtgtaaaagatctgaacactattgcaatattgataaaactaacgtactgaatagtagtgaagactatgactacatcaacctaaagaaggagggtatgtgaatcactgaaagacagaacacaattaaggtttagccaaaactctttgaatgagaaggcaaaaatatactgctgttgggaaacgtgaatgagagttttaaagccaaagttttgactgccgaaaggaccacttgtgctctctcgctcccgctctctctctttctttctctgcctaatacattaagcacacgtaagttggactggttccacctggaagacaaaagccacacaaagttaaaagcacaaatgcagcatgaagaaggaaagtcaggcggaactgaaaggtaaacct

SEQ ID NO: 9615 - DNA, 241 bp, artificial
  synthetic oligonucleotide
ggcagtaatgcaatggcccaaacacagttttaattggaacctcaaatcctgtgaaaaaataagaaattaaatcattaataaaatgcatttcccagatgacactatgttgatatatgttaagaaacctccattattttctcccatgagattcctatagccataattgcaaaatgtaaaattcactagttgtgccatattaaggttatttaatgaaattcaggcccttataaagtttcaagta

SEQ ID NO: 9616 - DNA, 344 bp, artificial
  synthetic oligonucleotide
ccatgacatgaatatatgtatggatagaacacaaaaacctaacagctgatgctttaggatatggagattataataatttgctgcctcttacttttcaatgccctgtatttttttattctgttatttgtggctatgttttttagacaaatatagaggaagggatgcctggatgttcttccaattgcataactagtgtaaatttgaagaaggtaaatgctggctgaaacacaagtaggattataaaaaagatataactatttctgattagctttgcttttctgcagagtatagatattaaaacacataggattcaatgtattagttacagtgtcaaagacagaaat

SEQ ID NO: 9617 - DNA, 229 bp, artificial
  synthetic oligonucleotide
aaaatgaaatccaaactcttgagcatggcttagaggatacttcaataactgacacctgtctaacttatccagtttcctctcttgttattccctcctttccaaccagccctgctaagattcaaacagatcatcctatattgatagtctctcagcactgatctaatttgctggcatatatgaggtttcaagcaaatatttaattaatgtctactatgtgcccgtgactatt

SEQ ID NO: 9618 - DNA, 1386 bp, artificial
  synthetic oligonucleotide
aaatattttctgtaataaaaaacatatatataaatttctacgtatatatatatagtgaccatatatatatacagtaataaaaattaattagagttatggaggactaaaggacattaggtaaaaactaaggacatctgaagaaaatatggacattggttaataataacgtatcaatattggttcattaattgtgacaaatgagcctacaaatgttagatgatgctaataaaggtaattagatgtgctgtatgggaactctctgtaccatctttgcgatttttctgaaaatctaaaattattgtaaaataaaatttttaaaataatagtacaatggggagagtgtggaaaatttaaaacaaaataatttttttccagtatagacacagaaatacagatatgcaaaacataaagcccataaatataacagttttcaaatagcatgatgcatctcataataaaaacaaccatttcctgagtatcttttttgtcagaaattttatttacataattctcagtcctctcaatgatcttgcaaatcaaatattatatgtccaaaatttatagacaagtaagtgagtgaaattaaataacctagccaacacggcacagtttgttgtaacagaacacggatctgaaaccaagtttatgcaattgtaaaagctgtgaactataagaactattagaattactagtaggcagccatataacctatatattctttgtagttgcaataacacacatggaatagaaacagttcatcaaattatagaaaatcaaagaaaacgaattagaaaatgtatcctatttgtgcagacacattttatctttgaagcaatagaaatttaaaagcataaaattgtcatatttgaatataaaaattaaattttttaataagacttaatagaaaactaaactagaaattgtgaaaagtatttgcacttcttataacacaagatttgtatccataatatataaagaatctattcaaatttatagaaaaaatatcaagatctcaatagaaaaatggaaaagaatttgaagagatatgtatcataatggaaaattagtaatcaaacatgttggaaaatgtgaattctcacaaaatgtagtcagactggactcactttgatatttttatgaaagcacaaacatatttataataataatagccagtaatggtaaagtgttaatatatttcaaataaagtggtaatacaaattgcaagaacccttttaaaaagcaatatggcaatatgaaccatacaccaaaaagtatatacacgttttgacccagtaactccactgctaggtatttctcttaagaaaataatttaacagtagaaaataaaaaatgtgcagtaaaacatgcattgaaatattatccata

SEQ ID NO: 9619 - DNA, 427 bp, artificial
  synthetic oligonucleotide
aaaaaaactctcagttaagcttatttttatgaaagtgacttgcctatttctttttgggaatgaaagggtatgctgtattattttatataggtaagctatatttttcctcaattctgaaagttcctcatgtaaaataaaacaatataaataaagcccataaattcatcaatcctgcaacaaaggactttatccatctaatcatgtttgatcataaaatttgctgggaagattataactgatttatcaaacatcacgattataaaagctgtgactcagaggcaaagcaacacagggagtatgggggaattgatggatggtgtttgcacatgtgacaaagagaagaacagatggagaaagactgaggattaaaaatagagaggggtagggacacagtcagttgagaagagatgaaattctttagaacagg

SEQ ID NO: 9620 - DNA, 515 bp, artificial
  synthetic oligonucleotide
aaacaaagtagagcgccagagaaatacttcccacccaatgttttgcatatagaaggtgctcaataaacatttgttaaattattcaattatactaaattaagaagctttaaaataaagttttaacagaattttcaattttacattctactgaggggtcaagaaaatcagaaactgtctgtgcctccatccgtcactacaaaatccactgtccaagtagtttgccatggagacagaatcctagctatgtatgccctcaaagcaccaacctaatgggaactgggctgattcactacatgactattaagcatagccgatgacattagaaagtgctgttcaggggtattttcattaaaatggacaaaaatatatactaaaatgcttgcggtagggggaagaaaatctgcattgcagaaatgacttaaataccacagttcataaattatctcttttatactagttattgattcttgtcaatgcaaatgactacgggttttattgcagacaaaaaatgcaaa

SEQ ID NO: 9621 - DNA, 5614 bp, artificial
  synthetic oligonucleotide
ttttaaaattatttttagaaattattttagatacagggggctcatgagcaggtttgtcccatggatatatagcatgatgctgagatttgggctttgattgaacccttgatccaaatagtgaaacatagtacccaagatagtttcttaacctttcccctctccttcccttccccactttggagtccccagtgtctatttttcccatctttatgtccatgtgtacccaatgtttagctctcacaagtaagaatatgttaatccactatggataataacattcagctgcatccatgttgctgcaaaggacaaaattgtgttctttttgtggctgtatagtattctatagtgtatatataacacatttcctttatctaatcgatgatgggagggcgcctaggttgattccatgtctttgctattgggaatagtgctgtaagaaacatacaagtgcaggtgtctttttagaagaacaatttattttcctttgcaaatatatccagtaatggggttactggggtgaatcgtagttgtcttcatagttctttgagtaatctccaaactgctttccacagaggctcaacaaatttacaattccaccaacagtggattggtgttctctattctctgcaaccttgccaacgtctgtaattttttttgactttttaataatagccattctgactggtatgagatggtatcacattgtggttttgagttcagtttctctaataattagtgattttgagcatctttaaagtatatttgttggcagattgtattccttcttttgagaagtttccattcatgtcctttgccccctccccccacctttttttttgagacggagtctcactctgtcgccaggctggagtgcagtgtcgcgatctcagctcactgcaacttccaccccgcccccacccccaccgggttcaagtgattcccatgcctcagcttcccaagtagctgggactacaggcatgcaccaccacgcccagctaattgttttgtatttttagtagaaacgtgatttcaccatgttgaccaggatggtctcgatctcctgactttgtgatccacccgcctccgcctcccaaagttgcccactttttaatggggttacttgttttttgttgttgttaatttgtttaagctccttgtagattctggatattagtcctttgttggatgtatagtttcaaatattttctcccattctgtaggttgtctgttcactcttttgaccatttcttttgctatgcagaagctccttattttaattaggttccaattgtgaatttttgtttttgcttcatttgcctttgaggacttagtcataaattctttgcctaagcctgcgttcaagagtatttcctacgttttcttctagggtttttatagtttgagggcttatatttaaatcgttaatccatcttgagttaatttttgtatatggtgagaggtacaggtccagttttattcttctgcatgtggctagccagttttcccagcattaggtgtgtggctctatttacaggttctcaatcctgttgcattaattatgtgtccactttttttatttttcttttttctttttctttcttttttttttttttttttttgagatggggtctcgctttgttgcccaggctggagtgcagtggtgcaatctcggctcactgcaagttctgcctcccaggttcatgccattctcccacctcagcctcccgagtagctggaactaaaggcgcccgccaacacacctggctaatttttgtttttgtatttttagtagagactgggtttcaccattttagccaggatggtcttgatctcctgacctcggagtctcactctgtcatccaggctggagtgcagtggtgcaatcttggctcactgcaagctctacctcccgggttcacaccattctcctgcgtcagtctccagagtagctgggactacaggcactacaggcgcccgccaccacgcccggccaatttttttgtatttttggtagagacggggcttcaccgtgttagccaggatggtcttgatctcctgaccttgtgatctgcccagctcgtcgccaaagtgctgggattacagtgtgagccactacacccgaccaattatgtgtccattttttcttacctgtaacatgctgttttacttaatatagccttatagtatagtatagttcagtaatgtgattcctccagttttgctctttttgcttaggatttcattagctattcagattccttttggttccatatgatttttagaagagctttgtcaatttctatggaaaattacattaataatttgataggaattgctttgaatctgtagattgcattgaacaatgtggacatattaacgatattgattcttccaaaccatgagcacagaatagttttctattttcttgtctcatcaactatttctttcatcaatattttgtagttctcactgtagacatatttcacctttttgaatagatgtactcctggatattttcttctttttgtcgctattatagatgggattgcattcttgatttggttgtcagcttgaattctattgatgtatagaaatgttactgacttttgtacattgatttcatatcttgaaactttactgaagtcatttatcagacctaggagtgttttggcagaatgtttaaaattttctaagtatagaatcttattttcagtgaaaagaaataattggtttcctcttttcctcttgagatgatttttaattgtttctcttgccagattgttctggctaggacttccaatactatattaaataggagtgatgagcatggacatccttttcttgttccagttcttaaaaggaattattctacgttttcttcgttcggtatgatattggctgtgggtttttcacaaatttcacttattatttcaaagtatgttccttcagtgcctactttttttatggtttttatcatgaagagatgttggattttatagaatgctttttctacatctattgagatgatcgtatggtttttgctttttaattttgattatgtggtgaatcatatttatagatttgcatgtattcaaccatccttgcatcccaggaataagtctacttgattgtgttgtattatgtcttttatgggctactggattcagtttgctcatatattgctgaggatttttgcatccatgttcatcagaaatattggcgtgtagttttgtttttgtcatgtctttgccagattatactatcaaaataataccatacctgcttatgatatcaggatgataccataatctggaggggtccctcttcctcaattttttggaatagtttcattaaaattggtaccagccattatatgtacatctggtagaatttgtgtgtgaattaatctagtccaggccttttttttggcaggtagatattttattactgattcaattttgtagcttgatattaatctgttcaaagttattatttcctcctgggtcaattttgacaggttgtgtatggaatggaatgtattcatttttcttttccagattttctagcttgtgtgcatagagatgttgacagtatctctgaaagtcttttgtatctatgtgggattggttgtaatgtcaccgttatcatttctacttgtcctttattggatctactcccattttttttctttggtaatcaagcaaacagtttattggtagcatttattctttcaaagaaccactttttttcattttgttgatgctttgtatggtttcgtaagtctcaattttgtttatttctgacgtgatttaagttatttcttttattctgctaggttagagtttagtttgttcttgtttttttctagttcctttaggggtaacattagtttattatctgagatatttccatctttttgatgtaggtgtttagcagtataaactttcctcttaacactgtttttttcatatctcagagactttggtacattgtgtcactcgtttcatttatttcaaatagttttgaaaatttctgcctcaatttcattgttaacccaaaagtcattcaggagcaaattgtattgtttccatgtatttttatggttttgaaagttcaccttgatatgagtttctgtttttattccaccatagtctgagagtatgcttcatatgattttaatatttttgaatgtgttagggtatcttctacatgtatatgataattttgtatattctatggttttggggtagagtgttctgtagatttctattaactccaatttgtcagctgtcaagtttatgctcagaatttctttgtgagttctcttccttgatgatctatcaaatgctgatggtgccatgttgaagttcccctcttttaatgtgtgagtgtcagtctttttttggatctagtagtaattgttttataaatctgggtgctccaatgtttggtgcatatttatttatgatagtgaaatcttcctgttcaattgagctttttaccattatataatgccattcttcatcttttttttcctgttggtggttcagtctgttttattttacataggaatagtgattgctgttctttttcattttccatttgtattgtagatctttctgtatccctttactttgagcctaagggtctcattacttatgagatgagtcttttgaacacagcagaaggttgggtcttgattttttgatttgccactctgtgtctttcgagtggagtgtttaggttgcttatgttcaaggttattattgataggtaaggttttgttcctgtagtggtcttggtagctagttgccttgtagtcttgatgtgtagttgctttatatggtctgtggctatgcacttatgtgtctttgtgtggtagcaggtatcattcttttgtttccatggttgaaacttctgatctgtagagagtatttacctctcttcctctcacttttctttccctcctatggtcttctggagacctgaaatgtcccattatattgaatttatttaaaaacaaactgttttattgatgctgcaaaactgaaaacctcccatttactgcatatagcttaagacagtaaggactctgagataggaccctatttaatcattttcacttcaaagtggattttaaatgtaaacaatattttacaagactcacaagaagaaatcagagtaaaaatatatctcagggaattgtacataattttcattttcaaaattttgttttgcaacacttttattttaaaagtacagaataagggctcagtttctttcatagataatgctgtttttaattaagagaacttttccttatttattgacaaataatgccatttcatattaacgtaataatttttgactctgtctaatgatacatacaaattagacttttgatgttaattgttaatcatcagtactaaatgacaaccctccaattcctttcataacttttattatccttaataacactattaaaatatatttactagaagttcacggaaggtgttggttctgtgcaacatagtaaatttcaaacatcattgtgtatatttaaatgaagcaattgaaatacaaagtgtttaacagacttggaagaagtcacaaa

SEQ ID NO: 9622 - DNA, 1644 bp, artificial
  synthetic oligonucleotide
aataaagtggcttgactataaagtctatttccagatgactgaatattttgtccataccacgagatcaagattctaatttgtgacctaacaatttaaccaacaaacagtttaagtcttttaatgagatgacaaggacttgcttatgaagccaattgccattttccttgctctatcataggaagcaatgctcgattactacagctcaaagtcggcttactttaaagcctataggagtctcctataatcaatcagttcacattatggtaggggcaagtagctcttctgtcatcaaaaataaaacagaataccctccacccatggcaccatataatgtccccaacttggatttacgaatgttattaaaatattgtctatgaatgaggatgatcatgtgtgaaaattagaaaaggtgaatttattgaagtaaagacataagtctatctctgtaaatagccaatatggaaggaaaacacattaaatttatcagtattacgaagctgaagcataaggtgaaaggtgtatggaaataatgctcactgaaaagttattcgaactatcaaataagagccacactgtaaattctggagaactagattaccagactacacagaacatgggttgggaggcctttaagggtaaatgggaatgataggatcctcattaaagttggagattttcaaatggaacaattgataatgcctttgaattattaattccaaatgggacaattgataacgccttcaattatcaactccgaaatggaagagttccatagacttcccttatataaaaagcatagtcttcactatcttcctatctttccaatagttgtccagaaatgttctacacaagagtctccttctctcaccaatgctaagcaaggcagtactgtgttcttttctctctctctctcctctatcctcattcacctaattttaacctgcaccggggtaggttaacacaaaagactcttggagattgaagaattacaattctcaatcactgactagttttcaatctccattctgttcctaattaaaataatctataacaggctacataagtaatattaactaacattctgatattttattccaaagcaataaaattagacccttgttctagagcctttgataataaaacagaaacaacagagtacttaaagctggtagtttatagactaatctggaaagaaaaatcaacaatatttgaaaagctcgaggaattttaacaaatggaaactaatgccgctgaaaggaaatgcaaatacaagggcttaggagtttcgaaaacaaagaagtgaagatggtggttgtagggaataaagagtggaggcagcaataggtcagtgctaaccaggcaatattcatagagaggtttagtctaaatctcaactttcaggggataatttgtcattattcagagacagaaatgaacaagcctacaggatttacatatttttaaattgctttttattgaattgaccaggatctctaggatctataaggtttttgttaacattatctggaaacctgcctctacatcccttcattttctctctgaagtttggtctgggtaggctccagactaacttggtctagaagtcccattgtccctttcttattacttagaattgtttttttt

SEQ ID NO: 9623 - DNA, 381 bp, artificial
  synthetic oligonucleotide
ggctaagagtgaacagaaatcttgctagaattattactaaggagactgattgtatgcagatggcctggcaaatggtaggtagggggaggtgttagcagcctggagtgacttggaagttggcaagcaaggaaagggctaattggaaaagggccatttcaaggattcactgtgctggcaggaagtcacaaaacatgtcatcaccctcactttcctcacttttttgtttcttctgattccatgcagttagtggttagaggtaagagaaggcatagactgtctcagtttggctaagttagaacagactctaggctccaggtcagtggttggcaaactttttctgtaaacagccaagtagtaaatagtttatgctttgcagaccat

SEQ ID NO: 9624 - DNA, 679 bp, artificial
  synthetic oligonucleotide
gaagcttaactaatttggcagtctctgaagtgccaaaagtgtcgttgagaagcaatagtactaagggcctgtcaaaatatcagaagtcagacagtgaactatgtaggcgacaaggttaaataccatcaaagagaaggactgaaagaaggtcaataattgcctggacaggaaaagaagatgaatagaattttcttttccttgcccacaccaccacagacctctgccagatggaaaggtattgatagaatttgaagtgaccaggaaaaatgcagaaggtgtgccctcagcttcacaacttgaaccatgaaatgtaaaaagaaccagtgcggggcaggttttataactcttagctccctagtctgagcatagccaactgaaaatatagagctcctacacacaagacatgtttgatgcacacgactgatatttaacatgtgaatataaatcatcataaaaaggtttattaaaccataagggacaggggttgagtttaattaaatgtgctagataaatgtttacacctaaaaccattaatactgaaaatccttcaaaagttaatttgtcagtttttttgtatgtgtgctatatttcacaatagattaaaaacataaaaattatatatatgtgtgtatatatttgtgtgtatatatattgacaatggattagtcctatagtcttt

SEQ ID NO: 9625 - DNA, 287 bp, artificial
  synthetic oligonucleotide
ccctaatccacctttcacggatgccaacaccacattctcaaagtttcaaatctagatatcccgttgcctcaaactcagcacatcaaagtgagcatgtcatccccctctcatctcaacctctctatttttatctcccaagctagaaacttgacacttaactttgactcttctatctatttcataccctacacccaccaaatccatcaatgtatcctttcacatgtctcttcttgactatttgctattaacaggtatattggcttagaccagcacttctcaaacattaa

SEQ ID NO: 9626 - DNA, 1784 bp, artificial
  synthetic oligonucleotide
acatattgtggttgtcattaccataagtttgatttggctattttcaaaaatatcttccagccaggcacggtggctcacgcctgtaatcccagcactttgggaggccgagatgggtgaatcacgaggtcaggagatcgagaccatccgtaccgaaaatacaaaaaaattagccaggcatagtggcgggcacctgtagtcccagctatttgggaggctgaagcaggagaatggcgggaacctgggaggcagagcttgcagtgagccgagatggcgccactgcactccagactaggcgactgagcgagactctgtctcaaaaaaaaaaaaaaaaacttccatgtctccacctaactttttgaacacacagaatacagttagttgtaattaacttttttatcattgtctgctaattctaacatctgtgtcagttctggtttgatttcaattaattgatttatctccttcttattagtcacagtttcctgctctttccatgctagggaattttttacaggatgccagacattgtgtattctaccttgttggttgtttatatgtctaagtttctataatcagtggttcccatctaaaggcagttttgtttgtctgaagacattctttgttgttacaactggagggtgctattggtacccaatgggtacaggccaggtatgatggtaaacgtcctgcaatacacaagacagcccccacaataaagaattatgaagcccaaatatgtcaatcattctgaggttgggaaaccttgctgtaattattcttgagttttgttccgggactcagttaagtttgttggaaattgtttgatccttttggggctttctgttaagctttgttaaatgagaccagaagagtattaagtttggggctaatcatttcaccatactgaagcaagaaccttctgtgtactctacttgtcttagttcaatcaggttgctataacaaaataccaaaactgggtaacttataaacaacagaaatttatttctcacagttctggaagctgggagtttgaagccaggacaccatcatcatctagttcttgtgagggcccactttctggtttgcagattgctatcttcttgttgtaccttcagatgacagagagagagagaatgacagagagagagagaaaggaatgaagctctctcctatgtctccttctaagggcattaatctcataattggggctccatcgtagtgacctagtaacctcccaaaggccccacttcctaacactgtcaccttgggggttaggatttcaacatatgaatttggggggcgaggggtatataaagactcagactgcagcactacccaatactctaattttagctggttgagagcaggcactattcccagccctgtgtgaattctgagcactgttcttttaactatttgggatagttccttttcaaacattaaatagtttcctcacgtgagctagtgaatctacattgtgtttgttccatccccacttcactgctagtacccaacctcagaactttctaaagatgcttaacactcatcatatccactctcacccccaccccagacccactcctcctcctgtatctccagtaaatgttgccagtcccttaagttagaaactcaggagttgccctccactcctccctcctcatcaccccaatattcaatcagttatcaaatgctgtcaatttgaacttgccaatgtcccctgcaccctgtccttactttccagcctcactatccttgccttcttagaccatcatcatgtcctgctt

SEQ ID NO: 9627 - DNA, 2981 bp, artificial
  synthetic oligonucleotide
agaatgttccctaaacctgttcagagaatgagcctaaaccttggtaatgggctgcccttagtctcattcacagactgagtatataattgcagagtgaagaaactccaacctggagaggtaaagcaacttggccagcatcacacagaaccaattctctgtcccagccatatattgaccctgaattttagccactaagaacaagattttaagcgtgtgggtgtatcagtgcaagtgacctctactagtaagattccaactcagacaggtgagtgggcaccacatctttgtctctgagggagatgccactgttccagtcttcacggagtactggggttattaaaaagaattcttgcctagggagagtgatttgtatgatgaaagaaatcaataaattgctgttgaatgcagtccaacctcacttattcaaactaattggaggtagcctttcaaattagtgaaccatctgtattgtaggttacttgtaaagtaatgaagctttattgttttgaataattcacagtagctccaagtaagctaacaagttgtagcctaatcgaggtcttaggagacttgccttaatgaaatgaaaagaatcctcagcatcaatcatttgtatgcaaatggtcctaccaaggaaatgataaagtttgctgccttgaagtatagaaactcagtgcacagagtccatttattcaattcatttatgactttgttgagagtggacaaagtcaagacagacagggcccaagctatccccatttggtactcatggagtgtcttctaatgaggttttactgtaaaaggaaacaattggagagcagcaggtgcaatccatccactgataaaataaaagatggttttggaatactgtcacttcctttcatttttttttcctaagaagacattagaaaaaaaagttaccaatgtaagtcaagtacctcggtgctttgtcaaaacccggaacaaacattaaggggaaaaaaatctgaaggtcgaggaagggaaataaacaagaagagtaagtaaagcatgaatcatccattaccacctgatggctccttaaaaataaaaataaaactatggaaggaaatagagtccatgccacagtcaggcatgttgatagggaacctggcatggactcttatttcgcagaaagaactgacctttggcttctaatttggattgccttttcctcaaggccttgcagagcacaaggttagacgatgctcgcctagcaccggttcccaattctttcttgggcactataagtggagccaaggaaacaattttattttcatgcatttaatttaattaccccaccttgtttcccaaagactttgaggtggttaatgacaatgaaaaaataatgacaaaataaaagcagagaattaggaccagggaaaatattaatagaaagttttaaatcaagagttaaagacctgaaaggtcatataaagttgcactacaggtttctaaaaagaggcacagttgggattcaaaccagctcagtccaatggaccaccttcggaaggagcacaggatccccagatggacctatctataagtgtgatcttgggctagatacacaacttccctgagccaatttcctcatctgaatgatggacctaatcaatattgtctatttcacaagctgttatgaggactcaacgaaatggtttctttaagccattgagctccactggctagcagagaacatgtgcttaataaatggtagctatgagaatggatatgaagtctcccatgatgcaatacaaagaatttgcccataatggcatgtcatttaatcttcgcaccagctcaggccttgggcccaggatcacagagaagggagagcagaggaaggagggagtccttggggaggcttcctacagaaggtggtaccccagtcagagcttctgtaggataggtaggatatgaggagatggaactaaaggtgaagaatgagctggaagtgtatgaggacagtaagaaaacctactaaagcagatggccaggtaggaaatgaggttatagagaagaggatagggcaggatgggctcatgaacttgcttgaatcgggccagatggtgaaggaatgtggatgtcatttgacaggaaatggggagtcattgaaggattttgagcaggttgagcaggggaaggatgtgacatgtttgaagggatgttttcaaaggtggagtctgtctgctgctctctgctgtgtgcaggctgtggtgggggttgggagaaacagggactggcagaccagctgcagtgatccaaggaagggacatgataagagctcaagctaaggcaacggtgacggagaagatgggcggttcccaatttcagttagaggcacctgagagggatgatttgactttctttctagactcaaaattccatgaggacagggaccatgctctcctggttcatcactgtacccctaggacctagcaaagtgcttggcacatagcaggcgcccagcaagtgttttatgaatgaatgaataaatgaatgaatgcctctatgcagacagacactgaataagaatggttgcttgctcaataacaagcaatagtacaaggaaaacaaaatagagaatttttttaaagaaaacattactttaactgactttctttcaccatccctggactacagtaacaatgtggtataggaatgcaactcaggagaaatctagagctgactgggaaagaagccctttaaagcagaacctgtatcagcagtgacgctctataggaagcatgccaaccatatgtcccctggacagttcgcacagtgtagaaacatcacaatgcaggtaaattatagataggagaagaaaaatggcagtatttacctcacaaaaggattaactgagcttccatttaaagtagcaaactgcctttctagtgtacttaatttgagaccaggacttgacgtactgaaactgggttccatccaagacaatatagagtaat

SEQ ID NO: 9628 - DNA, 1109 bp, artificial
  synthetic oligonucleotide
cccaacaaggcccttcccccctcccaagtcaggaaattcaggatgaggtatgaggtttcccactggggaaaagaagtggctctcccacctctccttcacaatagaggctaccatagcttctcacacaacattggccatattacatattattcagccaacaacacaatcaagtgggaaggaactgcctcccctctagactcagccaagactcctcctccaggaaggacctaaataaatggaattctatagcacttgatatgtaggcttcaccttttcctataacttcacagtaaccaatatagcatttgtataccattgcctctgggacctgccagggatagcgtcagaaagagcccagagcaatggccctcacaaagggacagccaacttgactgtgggaacttagcaaggcaatttcctgactttctgtgctaaagaaaccacatcatcagttcaacctaaatgcaggggtctggagagagacttaagagagttaagttgaaaacaaaaatccaacaaccagcctcatatcagcccgactatatataagtcctctgtatgcctaaaatggagagcttatcagtaatattcatcccaaatggcaaataatcctaaaaatcattgctgtttctcaacttacgagggttggtactgcaatttctcctaaagttaaccctagcatgcagtcaatcttcaacaagtatttattgaatgttaaataaatgaaagcttcatttcattcaagtgtcatttgcagttattctaactcttttatccatctacacctgcttgacagaggaccagtcggttatgccagaaagctctctagactgggagccagtacatctgggttctggtcttggctctgacagtaactctctatgtgaccctaagttacagtatttaatttgagggagaaagagagagagagagagaagcatagactacatgatcaatatgttcctttaagctatgtcgttcaacagaatctgtgttttatgacgaataatcatcatgtctcgtatttgggcagaaaaccccaacccttttaaccaagttggaacagctaaacagctggagatgggcaggggctggcagaaaaagcagtg

SEQ ID NO: 9629 - DNA, 1624 bp, artificial
  synthetic oligonucleotide
ctctccggaatccgctcggtcctctcagcgatcccctcctcctctcctcccctcccagtgtcaccggggctgcttggctctgcccccttcgccgccgcttgctccctgctttcgtccctccctctcttgctcgctccctcccttcgcctcctcctccccattcccccccacccgcgtaggccgcattctgggagttgtagtccggtggagcgggggttggcgccgcccgcggacccagccggactccacttcccgtcgagccctgcgaccggcacccactccaccaggcttcgctcgcacacagacacacacacacaccgctctccccctcactctttcgctcgccgcggctgctgccagtgtgtggctctgtctctcctccgctttgctgagccctcccttcttcctctcagttcctagagtccgaccgccgccgccgccgagagagaggagaaggaggtcggtggcgataaggggcggaggggggcatcagatcggggcagtattaggcgggtggcggttaagagggagtaagagggagcccgggtggcggcctgagcctccccgcggagccgacccgggaacaggtgcgtcttttttctctctcccccaatccctccaccccttttgactccccggctttttcgtatccccccacccgcttctttctatcttaagcctttctccaaccctgttccttcttttccctgcggccgctcggcttgccccccgggggcgccgtcctcttcgtgtccccggacgtagcgctccctggagctgggtatgtcttcgcccctcccttcgggacagctcccttccacttcccaccttcgtaccccatcccctgacttgccctacccccttctcgacccccttctctcttagccaggtgagactcgttcgccacgatccaagagagtcttcttcccggctgggcgggggtctccatggaaacgggggtcggttgatcctgggggggaaaccataggaattaccccactcctcggaaagggaggtggaggctatggtcttgttaactacctgactccaacccccgatccaaggatccgacgatccgaagggaggctggctagcagggcagggcgagaaaaggcttttttttggggggggggggtgtccgtgatgaagtgttgaagagaccgggagaaaatgccctccaacctcagaggggaggtgcgacgggtgctcttcagggctgctttcttcccggcgctggggtgcgggaatcgtagggtaaggggtacccctaggtggcggcggggcctgggttcgggagtgggagtgctgtgatgggggcaggggcaattatccgagtccctggaaaaaaggcgggggatgacttcggagcgccctggctccgctgccctcgctctaggggcgggggccgccgggccgggcgcggcggggagggggcttaaattgaaggaagatgagatcgggggcaattcatactagcaccggcaagccagaggggagatccggcgtgcaagccctccacccgcttcgcgccaggcctggaggcaaggggtcggcgagcgaagccgagggctggaaggagggaggctccggttacggggccgggtttcgggatcaggggcaatcc

SEQ ID NO: 9630 - DNA, 642 bp, artificial
  synthetic oligonucleotide
agaggggcatagtccgtaagcatcctttcccacctagcaaatcatggtactggattggcattgtttgcctgtatgcactttccttttgtctgtatgataagagccaaagctgggtgttgaagtttgcaagcttcctgacttgcttgtcactgcacttcagggcacggctctgccaaggccatggtcaatatggaaatggccatggactaggagcaagggggggtgggaggtagaagggctggtctcaaggcttgggcttatatagcatgagggagcttttctgagctcctaccttggtattaggttgaaagcctgggttatgatggctgtccacacagcagctctgtagggcatgtttgttggggattgggagcctgtaggaatgtatgtgctaggatcatggctgacaacagtcccactgtcaagccttccttgggggaaattctggatttgaagccaaactttagcttaggggctgaaggatgacctgtttcatggaacccagtttcgaggctgtgaaactctccatggagaggaaataagacaatgtacaatgtacaatttctaggggtcccaggtccaaatgtaactgggtaggtcaaagaaaaataaactataaacaaaagccataaactaaaaaca

SEQ ID NO: 9631 - DNA, 1765 bp, artificial
  synthetic oligonucleotide
tttctaaaagttgaaggaatccaggggaaaaaaaaatctaatgagttaaaggtgttcagttatagacattttattataattatgcttgccctttctttaggcccatatggtaaccttagggatatagttattttattaattacatggatgtacagatttttggcaccaaattaagactgagatttcaagtactttctgtgtatccacctcatatatgatccagatatgtgaaaatcatgacaattcagtacaacatttcaggcctaattttttttatagagaaagatctcatatggaggggggacatctcactcagtaagctgactcgctgaacacaaacccatattttatatcatccaatacccaatacagtctccaaagatttgtagttcaagaggaaggatgaaagagacagcaaaatcctatgacaccagtgcttcctagctacttttactgttttgtttcattccttccataagacaggaccaaacaaaccaataaatcagtaaatcaataggtatttaaagggtgttttttgtgtcatgtatatgtgacccaggtcaaatgctattttaagtaaactagtcccattaaaatgattaaatactaaaaaagaaaaccaccactttaattccaagaattcttattgctgaaatttcaattatgacataaatataaaaatattggcaattaccatattgtaatcctcacccaaactacagaatttatctttaaatctcttatggaagcaatttctaccattttttctagacatgatgaaactgaaaaatattagatttggaagaaagttttgaggttatctagtttattcttctatttctatagaaattttatctatagaattcctgacaggcctaaatccaggggcactgcttcgcctgggactcattccttgctgggctcccaggcattcagcttgcttttaaaaactaccacctactctattttgggagttccttttatttccctaaaacagcttcttgcttatcttacctaaaatgaagacataggatgtataacttttaaaagtttctactgataatcactgtaagaaaaacaaatgacagagtaacagataactaacaaagtcagaaattgtccaaagtcttacgcattcctcacagtccttgcccttttattcctaagaataaatttaataaaacctcatacttcgttcatttgtttccctcacatctcatctcctccctccagcccacaaaatttacagtttgtccaaagggaagtacaaattattaaaataaagacaaatagataataaacactggtgttacagatttctactatttctgtatctcatgttcacaataaacaaatccatgtggtaacgtaatctcatctaaaaccaagttgactggtgtagacagctgaccagctgttatttcatgtcatgttgaaatgcagattatctgactccataacacgtatgaggctgctttagaaagtatgtatattgggaaagggtgggggtggggttccttgtagaatgacatttctcatctaatggaactagggggttaaacatctcagaatgaagtgtgatgctcagtgaatactccaatctgcaggtcaaggagttcacaagcaatgttatgtctgccatacagatgcaaatgattcgtgggctttgaggaaagcactaaagaattttcatgattcttgtgtgagaagatcaataatctctttgtgcccagctgctttaacagttactgtcacaattcacttt

SEQ ID NO: 9632 - DNA, 3741 bp, artificial
  synthetic oligonucleotide
aaatattcctaagagggtagatcttatgttaagctcttatccccacatacacacaaataataaataagagaacaggaggaaattttggaggtaatggacagacttatgacatagatagaggatggtttcatggtgcatataattatctccaaactcatcaagttatatatattaattatgtatagttttatgtatgtcaaaaatattaagtaaaaaagaatgctgaattcaataaaagtattcctttaaacagcaaaatgtaattagaaaactcttttgtctcaaatatagaatttttttaattacaaatgaacaaatttaaaaatatgttagataaaatcactgacaatagatccatagggactactgaaagaaattagaatgtttttcctcccagaaatactactacgcatttgaggttggtattagtgggacatatgatgatttcctaataaagtcttctcagaaacagaatgctggattggctagatgacaggtatacctaatcatgggctttttcctttttttttttttttttttagacggagtcttgctctgtcgcccaggctggagtgcaatggcgcaatttcggctcactgcaacctctgcctccccgggttcaagcgattctcctgcctcagcctcccaagtagctgagattacagatgcatgccagcacacctggctaatttttgtattttctgtagagatggggattcgccatgctttggccaggctggttttgaactcctgacctcaggtgatccgcccgcctccgcctcccaaagtgctgagattacagatgtgagccacagcgcccggccaatcatgggcatttttacatttctacctatgaaataaagcacaccgggaaaaaaagtcaagctttattcttttagattatgataaatgtgcattaaatacctttttaaaggtccaggatgacactatcttctttctccccaaagatacaagcaaacatgagtcttcccataagaacttattttacatggtattggtatcctagagaggtaaatgcagtaacctaacaaattcaacttgtgagtattggctgtattacagtaactcagatgtatattgattacactgagagatacaatatttgagtgctatcaaacccacaccatattgttattctgcatgcttctcctgcatctgagatgcaaatcagttattctgtcccataactagttatattagaattttaaattgaagaattggaaacaattcaaagttgtagagaaaaatttataaccctctaaactgaaactgacatacccagagcaaggagaaaaagtgacccctcatttattcattcattcattcattaaacacttatttactgcctactatgtgtcagaccctatgttaggtgccaaacatttaaagatgggcaagatacgatcactgtcctttaagaaataacagcctggctgggcacggtggctcacgcctgtaatcccagcacgttgggaggccaaggtggatcatgaggtcagcagtttgagaccagcctgaccaacatggtgaaacccagttctctactaaaaatacaaaaattagccaggtatggtggtgtgcacctgtaatccaagctactcaggaggctgacacaggagaattgcttgaattgcttgaacccgggaggcggaggttgcagcaagctgagatcgtgccattgcactccagcctgggtgatagagcaagactctgtctcaaaaacaaaaacaaaacaaaacaaaacaaaaaaacaaaaaaaatcctaaatgggataaacagataaacataaaatgatttttaaaaatgtttaaggcaaaaataaaaatatgcataaggcaaactgaagtccagaggaaaaatcaaggaagacttcctgaatgagatagtacctgaattgagtcttgcagagtaagtaggagttcacctggtgatgagaaatgtagagggtatacttcaggcacaatggactacacaagcaaaggcaaagccatggaagacaaaagcagcagagtgtgtataaactataaatagattaagtgttttgagcaagggagtgacagaatccaacttgtgtttgaaacataaatgtctgacagggtgggggatgcattagaggaaataagggaggcaagaagacaattaagacaccattgcagtttagacaagtaatgatgtggtgcttaactagggataaggcaatggcaatagagaggacagaagagactgtggtcagtggtcaatttacttaattttaagataccacattcttttgattttcctcctactcctgctcactggccattctttctcagttttctttgccggttccttgtcttctccgaaactattttttttttttttgatggagtctcgctctgtcacccaggctggagtgcagtggcacgatctcggctcactgcaacctctgcctcctgggatcaagcgattctgttgtgtcagcctcctgagtagctgggattacaggggcaagccaccacacctggcctaatttttgtatttttagtagagactgggtttcgccatgttggccaggctgctctcgaactcctgacctcaggtgatccacccgccttggcctcccaaaatgctgagattacaggcatgagccactgtgcccagcttctctccaactttttaacattggattaatccagggctcagttcttagatctcttctctgtcttcactcccacggatttctttggatttaaaatactatgtatgtgctgaacactcctaaatgcatagctctagttcagacctgtcctctgtgctccaggtttgttttctcacctaactgcttgacatttccacttcgatgtctagtaagcatctcaaaccatcaagtctaaaactgaactcttacatgccaagcttactctacctacagtccttcccatctcagtaaatgtaacctccttcctcagaaggaaaaaacttgggttcatccttgacttccccctttcacacaccatatccaatctattagcatatcctgtttgttgtaccctcataatgtatctgaatctaaccactcctttccattgaacagtttccaccctgcttccatctaccaccatctcttgcttagattactgaagcaacttcctatctggtctccctgcttccaccttgctcatacacctgtaatctctttttaagatagccacagcttctgcacagagaaggaaacaaaatgaaaaggcaacctacagaatggaagaaaatatttacaagccatctatttgataaaaggttattatcacaaataaataaggaactcctacaatgcaatagcaaaaaataataataataagtgagcaaagtacctaaacagacatctataaaaatgaccaggaggtatgtgaaaaggtacccaacatcactcatcatcagagaaatgcaaatcaaaaccacaatgaggtatcacctcacacctgcttgggtgaccatttatcaaaacaacaacaataaaaacaaaagataaatgtaggcaaggatgtggaaaaaatgcaactcttgtacactgttagtgaaaatgtatattgaaacacaatacggaggtttcttaaaaaattaaaaatataactaccatatgatccagcaatctcacttctgggtataaatccaaaggatctgaaatcattatcttgaagagatatctacactcccatgttcactgcagcataattcttaata

SEQ ID NO: 9633 - DNA, 1184 bp, artificial
  synthetic oligonucleotide
acacaatttgaggttctctgatgcctctctcccatgtccaccctggccagcttcctgccatgtgcacccttatgcattcaggccaaggcttcaggtcagtgtgctaattttggatttcagctcccctgctggccttggccttggaggcaggcttagattacatgttcctgccctggagagcaaacctatcctccccaaacaaacaggtacatgtacgccacacagtgaaacagacacacaaacattctgtctcacacacacacacatatacacacatacacactctttcacccaaactccaggagcaaatccctgcccagcggggagggagtgaaaggtaactgagccctgaaagacagctgggcagccagctcagcctctgccaggcacttttcctagtaagggcatcctttgggcgacaatatccaattgaagacacagccgatagggagctccatgactgtttcccttagccctgctagcaatgtccccagaacctttttgggttctgtatttagagagctgctggtactcaatgacccggtcagccggcagctggtgcctgcctgcctgcctcttctctctcttcctctcccaatggctgtatctgtgcccatagagataagtgattcgaattcctccagtttgtggtcttccttagtgctgagtgtggcccaggagtgccctttcccagtgtcgtttgtaagttttgaccctgcatgcttcaatccctcccttgccatttcagttttttccccaaagggctggatgaattctagcttctccagctggaggaatgtgtggataagtcctccagggtcccatcagtttatgaagatgggcttcccctgggtatgattccaaaacacccgtggattcatttcacaaatatttaatgagtccctattatgtgtcaaacattgttctcagtgtaagatacatagtttaaaaaaaaatgaaagaattctcaaaggagctcaagaataagtgggctaacatgccagtatgtgcttactacatgttaggcactgttctgaatgttttaccatctattaacttcaaaaccatttgttggtcttcaaaacctcatgatataaggaatattattatgcccattttacagacgaggaagctaaggatcagagaggtttcatcactgtagtaatttgaatagcatcctccag

SEQ ID NO: 9634 - DNA, 862 bp, artificial
  synthetic oligonucleotide
tctaacttcataatactctaacagggtctggaaaggcagagcccagagggagaattgcttctgggctttctcattgcaagatttgattaaggcaggctttcccgtaagacttctgaggtagactggggtgggtcttgtttggatgtccctgttatttcacaaacaggaaggatttccaatttcccacttagaaagaagaaccagcaggcctggggtcaaggtcagttggacatgacttcaccagagttttgccccgtgtgcttgctttgtgatgtatgactcatcataattaaattttgagctagattaactataattcctgcacttattaggcgatcagtgtttaaagcccttgtaaaagaggatgagctgctcattctgataatgcaattaactacccaacagagctaatattttattttagggaagagtaatttttgattaatgatgcattttatttcccaaatccctgcagcagtgggtcacatctttggtgagaaagccaaagaaaaagggtaaaattagaaaacttggagtgtttggaggcagattagtgtggattctacagagctggctgctctcttggagcccactcccaattcctgaactcctgctctcttaggtttacatgtacctcaggattctccacagcagaatacacctcaagaatatttttggggagcataaatctcccttgttccaatttcttcttacagaaacaggacataacatcagcatttctgaagttctttggctatgagatgctatttaattccattattcccagagcaagatctatgtgaagagaggactggttgagagggatccagagatgcttcctggaagaagtgatatttgaaaa

SEQ ID NO: 9635 - DNA, 1614 bp, artificial
  synthetic oligonucleotide
tggaaatgatgtttgttggttttggtacaaatgatttttttatgaaaaagtaatataatgaagttgtacaatgtttggtaaatagagaaaagcaacaggcaaacaaaatctcaccagttaatgcaaatgctgttagcatttgggtgcatttccttcagtcttttatttttatgcatgtttttcttcacatagttgcaatcaaaattaatacaattctgtgttttgtatttgttgttaaaaaactctttgtaaatataactttaatgattgcataatttttccatactgtggccattacaaaatttatataactaatatcattgctgggctagctttttttccctttttttgttactattatggtttatgtggatatgcttttccctgtctgtaggaagattttattaggatagattcctagaaggggagttactaggtcaaagggcctggggacgatttttggctctagacccatgtgtccattttgttttctggacttgtctgaatttgcagctctcctaacctagatgaaagtcccctttttatccaacctggacagcatcgagtatcgtcatggaaagaaaaaaaaaaacctctaaaaacgctctaattaattaactaattaattaatggaaaatactatcttatttttgtttcaaagtgcttttgttaaaaaatgtttttctcttttattttttcttcttattttctctctttgtactttttttttctaattaggttttctttttcctggactatctgttaagggctgaatttttgaagttggattttttttttcttttttagcaaaaacaaccagaggctgctctgcttgagggtgaagccgcctcccagttttccctccccctctacccccacccccatagttctctccaccaggtccagtgacaattggatgatgcagccttgataatcatccgattccagaatgggtggctgcattccttttctgaaggcagcaagggcactgtgccccagaatcatgccccctttgctgttgttgtccgccttcatttttttagtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagaggtaagctgtaccccggattgtggcatcctcgccttcgggagagtggaccctccgggcaggacggggcggattaggggtctggcagggtgggaggggctcacgcctgatctcggacttgatcagttctcctggcgtctggggaactgaagaagccggagttgaaggctgtttgttgaattgcggaagaggtaaaaattagttgagtttggtcgaaggctgggagttgagggggcagtaagacagacgggcagatgtcagggacagacaagtggacagagggccggtgaagagacagccgcagcaggtgcggtgcgagaatagggcagagcgagacggaagcgcagagggacactctggagagaactgggagagatagagacagcgcggtcgagagacagagagtagagggaga

SEQ ID NO: 9636 - DNA, 1346 bp, artificial
  synthetic oligonucleotide
ggaaagactggtcacccacatgccaagaccaaatggggaatccagagaattcccaggcaatgatgacggcaccaacaaattccaggctgaaccacattagggagttttctagcagaaaattaggagcaagtcctggcttctagggctagaaaaagccaggaacatgtgggaaacagatctcagacagatcttcctctcaaggagggtgaagaaactctgggaactggtggcactcaggcagaaaaagggcctagttgtccgtgggatgtccagaaaagtctctggatctgatagctctacagaagtacactgatccatctgcaacagggttcaggaagtatttgactttctaaatcccactaacttaaatgaccagttcaattatacattcctgcaaccctttttaattgaccatgagacaaatgggtcacatcttacagaaatctgtatgaagaccagcatgaatggtattatcacaagacaaatgtaaacatcatgttttgattttcacctttgttgctaggaaactcacctctaaattgtatgctttattgaacactctagaagcataatggggtgagggtggggtcaatatattttgtcaccatctccttccatttgcactgcttttattctttgttaacagattttagtctaattgcaccaagaattaaccagttgtaagccccctcaaattcgttttgaaagtagacaggcagtaaataatcatacagatatatgatattttctttgtaggcttgtcaaatttttcatatgccctttcttgggtttaatgtgagaggactattgaccttgccttaagctatgctcacctttgttcttcagatttgttgctattggccacaagggggtctgggccagtgtatgtcctgctagcagtcgaaggagtcattgctacaaagtaaagaaagtacctcattttgctagatgcttttattacccttggcaccacaataacagtttcctcaggtttcttgtcttgggaacacctaatggcaagatgctcttgatacttcagtaactaaagctcctttaatgggatccatgatggacctgccttgttttgttttatagtgaaaaatgttttaaggaagttgcagtatatattttgttggtaaagatgccttaagctattaaggccatttgttattttctgaaagcaagagagataatgctccctaataaaattcactgcactgcaggtagctctacgtttgtttcctacaaagtgctccatagctcttgtgggcctgtttctctctttcgtctttcttacgtccttataagatggtatgggggcacagcttttttagtgctgagcaatt

SEQ ID NO: 9637 - DNA, 1008 bp, artificial
  synthetic oligonucleotide
aaaagtggactttataaacatctctcttgtggaccaattcatttaattctattgcttggttatgcagaattttgtagcccttttaagtagagaaattattctttttctcaagttaaatgtagtacattaggtgatatttgaaccagtttatgggattctgctgtggcatgatgagctgactttatgtattgaagaactctgtccccaaatttaattatcttgagacatcaccaccacataggataaaatgagccattttgttcattgcatcagcagcctttgctgaaatggaggtgatgggataacaacttaaaggctaactcattaatgctcagggatgaatgaggtaatgtgtcagcagaccaaattggtgcccaaatgttttcatctagaggcccgtatctctttcccgcattgtgatatattaatggggatgtcttgatccgttgtcgctgcctgtagacatttgaataacgtagaagtaataccttctgggcactcaggcctgtgcgctatcaatttttcaaactccaaaggtctctcagtggatagaagcaaaattctgatagtgccataaagtgcctaatttataaagattcaaaccacggcatcagtgcagtccctgcttttttctgataggtgttttctactgagcactgcaccattcctaactatttggtgggggtagtggagcaaattagtcctccaaattgtgaagcctgtggatttatgcatagttgaaaccatttccgttctagcaatgtctaagtgggtgacctttctgacgttaatttgtttctccatctgtgccatgcattttgagaggacgtgaagaataggcttgatgatacccaaatgcatttccccctattttgtattgctgtgctgatggcttgaaggaggagttacctatactggggacagattctggagatgtcctttcaccagtgtgcattgaatgaggccagaaaattcatcttcatggagcctggaacatggaaggtttta

SEQ ID NO: 9638 - DNA, 638 bp, artificial
  synthetic oligonucleotide
attatgtcctgtggcagagattgcttgttatctaccccattatccattttctcgatcttctttggtaacaaatcactgaattttattcaggtggtaacatatctagctaaaagaatacaattttcagcctctcttgaggctaggtgtgttcagtgactaaattagtattaaaatataagtcaaaatattatgagaaatttctagaatgtcttaaatagaagcaaatcagtccccccaccaccaccccttattttcccctttctctatcctgatgcctagaatgcaaatgcaaaaaggacatgtatctatctgaaatgttcatagaaaacatatctggaactctaccatccttcttgttctatgagaataagggcagaatagttaactggaaataatgtgagtctgtgaatatcagagaattatcatagctgttctacacttctcatcttcagttaagtgatgtacaaaaatcatccatcttgtttaagccacaattatactaggttttctgtcccttacagctgaacttgattctaactgatatatcttacctgttatgtttccatgtcccattgaaggtgactaagccatgccccacagtgtttcaacacccgacatatctgagtaataacacctcc

SEQ ID NO: 9639 - DNA, 2511 bp, artificial
  synthetic oligonucleotide
tatccattaataataacgatattgataagaattatatactattctctgaaaaagatttaaaaggaagaagagaaactatcttttaccactagaggccccccaccgtgtggtgcgtagagacccataacaaatttcaaggtaaggaacttcatcttcattttaaactggcactcgactattacttttttaaaaagtaattaaccccttacgtgttcccaaaggtgccttcataatgaaattcctgttactattattaccagtgttactgtcgctactgttagagtactctcaaaagagcctgtctccctctcctggagtagaacttaaaatggggcggaggcagggagttaccaaaaccactgcagtgtatgctgatttcaataacctgtactgctaacgatccaatctcatttcccaagcctctactatcctcattaatttttctgccgatgtaccatctgttttccaatttccctctgccttacacgtgcagaacttgtggtagagagaagccctagtttggccgttctgcaagggatagcccaggaggtagggggaaccttaagttgaagtcacctgaagcatgtttggggtcagggaactcggaaagcaagagtgtggccacagatctgcccagaggcgcgacccccagctgaggagaccagatggcgggaaaaagcgggggtccaccgactccgcggctatctgtaatcctacccttggccaggccggggagccaagaaagacttccaacactccccaagtttcagctcaagtcgtctccgaggctgcgtgtgccccagcctcgcacgcctccctgcaacgtggccgcatctggggcgccctcataccctcagggtttcccaaactcttccattctcttcccaggcccagccatgtcccaggtctccgggtccccgggttctcctctccgcgtgccgggagagtctccagcttctcagactccagcaaccccagccaaacctcttcgctgcctggagccttggctcccgcgacaccgcccggctgcggggcgggggcagggccaacggcggaaccgcccccaaccgcctcccaggccaggcgagcaggcgggtggctggggcgcctccacctcctcttcctaaagcggcgaggcgcagaggagcggcatcactcgagcccaggtcccagccaccaccactcacagcgctcggcgttcaggaagaggagcagcagcggaggcggctgcttcagcggcgggcgggcgccagaaaggtagactgagtcccagggagctgcgccgctaacagcccacctcctagccccgggctacgcgccgccagcccagtaaccccacttttgtgtgtcctcccaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcaggtgaggaagcgcaggccgcccccgccgcccacgtgactgcttgggagcccggtgcgccctcggtgctgggcaccggcgacaagggacggccccagggctcccctgagggcagggccggtcactatggccaggtgacctgggagtagggctggaggtgtttcctggtgtgtaggctaggtagtgctcttcgctgggaaggcgaggcgggactggagcgcgcaactaggtggagattgagggcggttgggggtataaaaataggccagagccacagacacctgcgcctgctgagcttggcacggttggggatgggggggcggaacttaacctgggagagatggaagtgccttggaatttgtggggtataacgcgagtagtgagtgccctacaccccccaccccaaacacacactcaagttggggcggggcaacaccaggggtggcggcggcggcggcttgaattgggctcttcctgtgtgcgtagggctaagagagaggtgacctctttctccctttcggtactgctgcttaagggcaaagttgtagcttgctccccgacctagcccagcccatagtgtggcgtgagaaatgctggttctgttcagagtcactgaggtgatgacttctcagccccctccgtgcctttcccacaagatgactgttacatgtggttaaaggaagctttttgtcttggacaagggactactgcatgggacccaacttgttactcgaagtctacccagcccaaccccctcccattatattttcattttattaaagataagctatgtcagaaaactttttatgctgttatgtttttaaatcggtgcattttaggctatctgctaagtgttatccaaatttactaactttttaaagcattcatgttctatttttttttcctttgctagatggcctaaacaacccatttaggggctaaaaccactgaagcctcagtctttcatgatctaaaatgtgaaaacaaacttttttgaagttcaaa

SEQ ID NO: 9640 - DNA, 1181 bp, artificial
  synthetic oligonucleotide
atggggaagcttttaatcagaattttgtacctagctaaaagttttgaaaacttcctccaacggattcctaggctgacgtattcaagtaaagacaagatctttttttttattttattattattatactttaagttttagggtacatgtgcacaacgtgcaggtttgttacatatgtatgcatgtaccatgttggtgtgctgcaaccattaactcgaaagacaagatcttaacccaaccttgcttcaattcctccaaagtgtgacctgtagtgaggattctctagtggcatattgttcaatcttctaaatctcttatcccctccagtgctttctcatgctagcttttacaacccaaaggatgctgttgagctttttctttccatggtttgcatataagttaaatataggagaaacaatgggtttatagaacatgtattctcaaactgcacacatccgcccatccttgctgagactctgatcctaccccttaggtaaggtgcccccatcttcctccctcctagttagaaaacattgacttaatgtgtcatacagagaatgagcaggaaagggtgcaatctttgatgtgattgaaatggattctttgttgcttctagaatgtgaactcctcctaagcctcctgtgttattgaaaagaagcagtgtgagcagtttgcctatgtgcattgtttaattacctatagcggaaactggaacccttgctgcagagtagggttttgggctttgatttgggctcttccgaaagcctgaagaaagcatggtattccacacaagtcttccagaaagccttgcaggcatctcggctggccatggtgaactccaaggtatccttgcacaacacctgtataaaccaatttccattaagtaaaacatccttcaagaatatcaaagaccttcaaatcccaatgccttccaaactattgctccgttggcccatgcagcttctgattttccacttggctccctgtaggtttcacacctgctgaaacctaatgattggcaaccttgcgaggaatagacagggccactgctcacaaacagagccttctctaagaagcaaatattgctttgcacactcccctcaccttaaataccttttttactcactcttctctgccagaaacatttttatgaagtaaattagattaaaatcatgtcaaagggc

SEQ ID NO: 9641 - DNA, 2060 bp, artificial
  synthetic oligonucleotide
agcaagtgcctagaacctatacatatcacataatgtggctatgagcatctgggaaagtgtggccctgccgtcatgagaagaaccccctcttttgattgcttatgcaggtagtggatcatgtacagcaactgtttttatttattatttttaatggatgaataaaaattatatgtatttatcatgtacaacatgatgttttaaaatatgcagattatgcaatggctaaatcgaggtaacgtgctttacctcacatacttatcattggaactgtgttttcaatgaagattcttttattgttttctctttttttgtttgtttttttggcctcattccaaaagcaatatatgcttatttaaaaagcagggaacaaaagaaacagaaaagcaagaagaaataaggtactcctaatcccacctatcaagagacagccaatctaaggatcacagagtaaagctcaatgcatgtgatgtaataacaccttttggtgaccaacttttttaaaaaaatgtagtattatattgtgaatatcatcattagttactgttatatgaaactaccttgttggacatgtaagttgttttctcccttgagctattgcaaacaacactaaaataaacatcttagtacacaaagatgtacatgtatctttacataaaattttatttccttaggatacatttttccagaaactgaattttcccagcttatttggggtacatttttggttgtcttatttttgcttgagactttgaattaaatactaaaatgtctaataattttttgtgtaaaactttaattaaatacggaaatatgaatacaaattatgggaaggaatcgtggcagtggtagttcttgcttggtaaagtagtgaaagaattatatgaacccaaactgtgcatcagaattccagaggcagcaaaccataggggagagagttggggattggaatgaacgcatctacttttaattcctgactcaagtacttacttgcagttgtatgaccttgagctcatatttaaccttgctgaaccttgatttctttatttgaaaaatcttttttatgactttgtgttgcagaattttgctccttagttcagctaaaaccaggttcttgtcacacgaccaggaaaatttaggcacgcagacgcattgaagagtgagtagggcaggattttattgggcaaaaaagggaaaaaagaaaaaaaaaaactcagcaaagggagatggagctcttgctaataggtccctgacctcacagattgaatcccaggccaccacacaggaactggaggccaagctcctccccctgcccatggctccaccctgttctcccagtgcgcatgtgggcatgctcagacaaggcactgggcaggttcccccatctgcacaaaagcatctgatgtaaacacttgtggagtgggccagagattctctggggacccctttttatctgcctgggcatttagctgtctcatcagttcctgcttgtctctcctgtctcagccctcagtctctcatcgctctctctcagtcccctctgccctcaagtttaagattcaatcagattaacctactccacaggccttttcctgcttctccctttgtctggaccaaccttcatctctgctcccccacagccccccaactccccaacacatacctaaataattagtactggctatctggggttcagattagacatcaccttccttagaaaaaccttgcctgtccgtcccctccacatacacacttcaatctaggttagatgcccctcttttgctgtgctagaaaaaaaaattatcctttccactgtcatttgtacacatcacaccataatatacatacctgcttatatctctgattcttcccctagcccatgatctctttgagattaggtactatttctcattcatctctgcatcctcaatagccaacacagtgtgtggattcagtgaggacttgttaagtgagtgatgaatgaatgaaggagcataatcatacctatttcacagacgtattaagtaatgattgtatgaaataatgtaagtggaagttcctgg

SEQ ID NO: 9642 - DNA, 1358 bp, artificial
  synthetic oligonucleotide
atggcttaaaatctttcaatgatcccctatagctctaaaagtccaacttctgtctaaccctccaggcttatctcttactactctctgtctcctaaacatcttttgaaattggccatttctttgttgctctacaccgtgagtccaatctgccaccatactcaatcagtactcttgaacagcttgcaaacagtttttcctagcttcagccatgccccctttgaatccaccttccacatagcagccagggtgactcctttgcttaaaccctttttatgcctcccaatttgcctaaaaacaaagatcaagcttcttatcagggctataagaccttccatgatttgaccctgctgacttatcccccttcatgcttacttactcagttttccatacacactgcttcttcctatccatggacctttgcaaacattcttgctttctggaatttcctgcctctggccttgcacgtccaagtctactacatccttcaaggcctagttcaaataatactgtattcaggaactctccccgaactcccccgaggaacagttcttcctggctttcagacgtctcattttgcattatttttgtctcatcactttctcatttagtttctcatcatgtctagtatggatctctctgcctcaaatctaagattgttgaggtttaaccacaaattttgtttgagccacaaataactgagtcttaaacagaaaaaaaaaaaaccagaggatctgggcaatacctgaaggtattgattggggggatgtggctatgcaagtgtgaggggtaacaagcttaaatatataaactccttggattactaaaatagattagaatcatccctgctaggtggtccaatgtgtgaatttagatcgggggagttaaatcaaaatgagagaagttgtcgtagagttgaaaaataaaatcaagatccttggcaaggaactagatctaactagaaacgtgttagaaagatgtgctcagcgtatacctctgaatgtgcatatgtatacataaatgtgcacatgcatacttttttatagatatgagtgattacatatatgcatgagtttaagtgtgtgaatgcatggctctgcacagacatgtatgtatctgggtatgcttatgaatatttcaaatgtggttttatatgtgtgtatagttgcagagtagggagggtcttagcttgagcctcagctctgtcaattgttgacattcacacatgcctgggcatggctgagaaactggtggggcaggcccgtcagaaatatatttgtattgaaggactaaggatcctcctgggagataatttatcctggaaaaagaaagaggtatacaaacttggcccagtaagaaag

SEQ ID NO: 9643 - DNA, 997 bp, artificial
  synthetic oligonucleotide
tatctttagaaaatcttagtaaataaagtagaataaataggttctttcttttccagcttataaccttgactgttcatattaaggtcctctcatgaccatccatgagtatggttacaggatattagacaaattgaggaatatacaaagcatttactctgaaacaggccacaagtgcaggccttttcttaccatggcagaggcagctgaatggttcatctgatgatgagctgccttgagtctggcttgcaagtgtgcaggaggatgaaagtacttgcatttctcccgcgagcatcgacctttgatgtaatccatgcagattgtcacagtattatcactcgcttcaatcatggaagcatcagtagggtgagcatagcggcaatcattctccccacgggtacaatttccacgctgaaattctcggcaaaccttagaacacacacatgcacatacacacgcatcacactgatgactggaagctgactggcttttatttattttgctagtgaatgtaacagtaattatatatacattgaatatattatgtgtgaacaaatctaaaaagataaagaataatgtaaagccatattcactatgagatataaacagacagaatttctattcccagaaaaaaattctattctccccaaaaggaggttgtccttacattgaaataaaaatgtttaaaaaagtattactgaaaaccagttttaattctccagttaatacacagccttaagcataattagtgtttttttaagtccaagatgagtctttatcacaccataatgcactggttttccaaagtcaacttgtgaaccataactgagttatatgtacaatcagattatattacaatacattactaggcatttaagcggctgcaaatggagctgactttgtaaggaaagactagttatttcaatgtacaaagaataacaatagaagaatgaaggacttcaataaatcaaaaagctgtttgaaatttctttcagatttt

SEQ ID NO: 9644 - DNA, 931 bp, artificial
  synthetic oligonucleotide
aagaattcacattctcatggaagttatcttgaaagtaaaacaagagaagaaagacatgttttcttctaatctaatggaaacagtaacttgtcctagagctgtttgcaaggccactgccatcagctacttttgccccagttttcctatactttccttgtctcctactttcttttgcctcccctccacaaaccagcacataacaagaacactgccagtgcctggtccagaagatcacaaagatatttggcacctaaaccaatcactaaagaggtcttcctttaaatgcatttatcaacccctgaataaacaatgaaaacaatgttttctttgtttccattttaagctttccttacatctgtattacttctgaatttcttgtggtcatttattttggctctacaaatatatgacacacctgccatacactgcttgaattggatggctgacaagatttaaaagccttcaagttttcaaatttgcttcaagttctatttccctcacgtgttttcgttagtggtccaccaccacacgttctgtaaggaatataagaggtgctcagcacagcagatggaaaccatgatttcataggcatcctatggaaaaccaagtcttctgtccagaaaaaaaaaattgtcgtaaaaaataaggatattttgcctacagaactttttcattaacttttttttaaagctttgctgcattttttcataatactcctgggatagtaaattccatatgtcttttttcaaaaagcaggtaagtcaacttattctattttgcaaaacaattaaacaccccaactcagttcatacatataatcataaaaggaaaaaataggtgcaacagtgtctcttttgaaaatcactttagcaatggataaaataatgttactggcacatcttttttaaaaagatgtgtccatttttaaata

SEQ ID NO: 9645 - DNA, 1186 bp, artificial
  synthetic oligonucleotide
ggcattttatattcattttctcatttaatcatccccaatatcctatgaggtacatacttttaaagggcaacattaaaatttcatttaaaaaccaaatcagtctttcacaaattttaattctagacttgttaccaaatcattgtattgagtttttcaatatttaaatttctcagaaatcataagagtcataaacaccaataaaaaatctccaagttctcatttcccccaccccagattcctgaaatgacaataagaaagcttactactccctacccatggaagccagagcatcctgaattgcttataatttggaaggtatatgttttcatacatatctggcaaataagttagaaactgcttgacatagtgggtttaaaatcatcattcaaaagaacatgtggtccagaaatctggcaaccagctggcagaagggaagcataaaagcccttgggcacggtaggtccttgctctaaaaataaaatttttctaccaaaaaaatggctatccaaatcaaagtgaaatctctgaaccaagatttggaaattatgaaaaaactaggaagctataatactacaacaagattgtcagtaccttcacaaattcaactctgttgctaacttgtaaatttactatatcaaaatctggagtgtgcaagtcataaaaagaaggcaaaattttttaaaaaaagatttcaccacaagaggttttcaggacaagatctgagtaagagcctacaaataaaacagggatttgaaaataaaactcaagggaaatactgaagtcaaacaagcaagcaagtctgtacatatatgttgttaagtaccaacatatatggaaagtaagaagatatctatagattaagaatcatctcaaaaatcaactcagcttaaatggctaggcaaaaaagaaggaggtgaaaaaggaggagatggaggaggaggagtcatggcttaaatagtaatttaaagagggcatttacatttatactgaagtgaagagaaagtccatcaaagttgatggattcctatactgtaggtaggaatcatgtgatgtaggtatcatctatgtcactaggtactgaatggcttaaactattaaatctgacagccatataattccatatacagaaagggaaccaaaatgccttcattctatttaaaataacagtataatcctacaaaagatc

SEQ ID NO: 9646 - DNA, 1136 bp, artificial
  synthetic oligonucleotide
cgaccccaggcagcccgggctggggccgcgcctccgtgcgtcccgcgccggacagacgcggcacgcggagggaaacggcgccagcgaggggctttaggcgccaaaacggaaactcccgcgaaactccgcgggccagcggagcgcgggcgggcatccggagcgccggactcggaagcggcgcacgcggccgcccggccccgccccgcccggccaggtagcgcggcgccgccgccaacctcacctggctccgcgcgccgctgcgggacgggcgggaatgcggccaagggccgccccggctcccgcgcccaccccggactctctggcctccgcctctctctcactgctcccaaagagcgccaaaaagtcgcgctgcggctcacgctcggagtgcgggcactttcttcctgtagggcgctgtttcgtcgcgaaatatattctttgtgtggttcgctcactcgtgcctggttctccgagagcgcagcgcgggctttattctcagggggtgtggcgcctcgcccccaaacccagcagcccagcccccgctgcacagaccctttgtcatttcattaggaagggaaagggggacaaatcataacgctcagattttacaaaagcgaaaacaaacgaagcaggcacacatccccagaggcggggttggggtaggggtgcaaagtttctggctcttcaggaactgaagtgccagtgagaaaggcagtgtggttcacagcgggacgctcatagacacttcccagacaggtgaggcgaaatgggtcctttcaaaattgatcttagtcgatgaataagtccactcgctacaggctaaataaatacattcatactcaccagctgccttcttgggggttttatctttcataaatgccccaatcgtttatttccctctaagaatttcagacagggaaatgctgatcagtgcaatctgttccccttcttccacggagtttgcaggataagaggaaccctgaggtaaggttccagatactttggaaaatggacaaagcaaatgcaattttatatcttgattaaaaagtgtgcatctgcacagggaaattacaagtttcgatttaatgcaagtgtaataggagcaccagctgtcccttaattggagccccacaata

SEQ ID NO: 9647 - DNA, 2446 bp, artificial
  synthetic oligonucleotide
tacaagggggagggaggttgggctcaatgttctccaaggccccttccagccctaatgctctcagatcttttgcttgcccaaggttagacaggcacagggcaaaaacaaaagtccagccagagaggagtcagctgtctcatctatttgcagatgttgggaccaccagaggatgctgcttcttggggctccacactctccaggtgggaggctcattctcctccccactatgggaaggaaactgcaggctggccaggtttggaaaacaaagccatgtggaaggcatgccatgagtgacaaaaatcctatgttattttctttgatttttttttaaaaggttgacatttttcaaaataaagctgttacttctctgccacaatgcatgggccagttagcgtgttcatgaatcagacatcaaatattttctttcttccccaacatagctctctctgtgggaacagagagtctagtatcaataataccattagaggggaactacccttcaacatacctaagctgcaattccaacctgccaagcagggaaaaagtgatcccaaatcctatagccgttactgtctacttcttttcttttgaaggaccctttgatttctttctttcttttcatcttctttggcttttcaagcctatcttgaacactttggtgatactcaggaggtcattaggcgtttgcctcttgttaagcctcactcagaaaaggaccgctggtaatagaaccaaaataaatcttctcacatttaactcctctctcccacaaagcagctgtccttggctgccaccactgttgccacaatttaaaggaaggtggctacataccaacctttggtgcccagggaggagccatccacaatgacacacacttggccatctacgaatgctgaccaggatggagctgagtcctaacgcttggatcatacttgggaaaaacctttctacagccagatgctctttttttgagacggggtctcactctgtcacccaggctggagtgcagtggtgcaatcatggctcactgcagccttgatctcctgggctcaaacaatcctcctacctcagctgcccaagaatctaggaccacaggtgtgtgccaccacatgcagatgatttattattattactattatttgtagagacagggctttgcagtgttactcaggctggtcttgaactcctgggctcaagcaatccacctgccaaaggcatataacacaggcaagcctcccaaagtgctggggttacaagcgtgggccactgttcccagcctcagacactcttgatttcatttattctctggaaaacctgtgcccatgggaggcctctcatctctaaaccgagattccccaaatatggcaaatgcatgcatgccattgctcacacagttctcctcgcttggaatagccttcccacctgacccagctcaaatatcacctcctctgagcagcctttcctgaccctctcccctcacaggcagagtaatccatccttccttcggattctcacagcacactttgttcttgccgctaccatggcacttattacattacattagagccaagtggtgactgccttttacctctgagtgactgtgagcttcttgaggacaggggcttcatctaatattggaacaattagccttgggctcagcccataaaattttcagagcttgaattgaaggggtaaattcagacttcagcaatgaagttggaaagcagtcctccccagccataaaattctgtaactgtacaaataaaatgtggtcccacagacacacttgttttgggggcttggggaggtacatatttggccgtgttagactggtctagaaatcacaattcccttaactaaactcaccagatggttggcaatcaagctcaatcacttagttaaggtgaaccaacttgatatgtctgtgtcaggcaacagacagctggctaagtgactgacacccctgagccgcaggccacgtgcttatgggaaatggaatagtgtgtgggggttgggagaggacaagggagtctggatgcatttattttgaattgggtgatgcacttgtataaaagcaaattggaacccttgacagagtcattcagcagtatcaaagatctatagtcactgcagcctggtggggggagtgctactagttacagttgcttggctgtaaataaaatctcccctggaatgaagcattttaattcgaagtgattctataaggagcagctgaaaaacctttcaaggaagctggcagtgttaagaggaacctctataccaataggaaagggctttgaaaagagctaatgaagtttcagcacgcagccctgaacatgagctaggcccatttagctactggtcagtgtgtttcagaaacaaagcaaattaaccggggtggggggcctagggaggacacaccccccagcttccttcttgaagtttc

SEQ ID NO: 9648 - DNA, 1765 bp, artificial
  synthetic oligonucleotide
acataaacatctcttgattaataaggtacctttgtcacaattaatgagctaatatcaatttgttattaactaaagtctatgctttatttagatttccttagtttttacttttttcggttgcaggatcccacattacatctagttgtcacatatccttgagctcctcttggctgtgacaatttctcagacttttctggattttgatgacttgataattttgaggagtactggtcaactattttgtagaatcccattctattggaatttttctgatgtttttctcataagtaggctgtggttatggattatagggaagaagaccacagagataaagtgccattcgcatctcatcatatccaaagacacatacaatcagcatgatttatgattggtgatgttcacattgatcacctggctgaggcagtatttgtcaggttaatccatggtaaggatacttgtctttccctttccatactgcacttttttttttttttttgaaacggagtcttgctctgtcgcccaggttggagtgcagtggagcaatcttgactcactgcaacctccgcccccctggttcacgccattctcctgcctcagcctcctgagtagctgggactacaggtgcctgccaccacgcccatctaatttttttatatttttagtagagactgggtttcaccatgttagccaggatggtcttgatctctgacctcatgatctgcccacctcggcctcccaaagtgctgggattacagatgtgagccaccacacccggcctgcaccctttttttttgacaggatcttgctctgctgcccaggctggagtgcagtggcatgatcaggactcactgcagcctcaacctcccaggcccaagtgatcctcccatgtcagcctcaagagtagctgggactacaggcacatgccaccatgcctggctaatttttaatttttttgtagagagggagtctcactatgttgcccaggctggtctcaaactcctggtctcaagcaatcctcctgcctcaacctcctaaagtgctgggatttccggcatgcggcaccatgcctggcccatactatactcttttacaaggaagtcactattcgcagttcatacttaaggagtgaggagttacactccacctccttgagggcagagaatctacacaaattatttggaattaccctgcacaaaagatgtgtctatcatccatttatttaaccatttaattatatcagtatggactcttggatgtttattttatactttgggttatagtccaataatactagtatattttctcaagtttttatacctttggctgttggtagctcttttagttggctcctgtgatgttctgctttttgtttttgtttgtgtatttgttaacacttccttactttctggcaatacaagatgttccaggcttatcttgtgtattttctgcctcagtcctggaatcggtcatttctccaaggagccctggttgcttttattgaaaaacagtattagaaaacaaacaagatttggattctacttgaataaatgatatttaaggcaatggttttttttttttaagtcaagaaaatatggcccacaggatggctgcctgattctgtatataaagtttaactggaaccaaggatggtgttagggtgggtcaagagaggcaggggtgtgcaagggcagagttggaaactgtatttaaaattttgatatttgttcattttggatttgtctacattaattttaagtctttaaaa

SEQ ID NO: 9649 - DNA, 525 bp, artificial
  synthetic oligonucleotide
tccaggtccaaggtctctaatgccacgttccagagatgtttttagcaggcttatttatgaaccagaaatagtatataaatgtttagggaatatactacacatctacttgatgtatgcagtcattaaaatggataagcacccttacatcctgcagatgagagaataaattggtaccattgagccaggtgcagtggctcttgcccatagtctgaactactcgggaggctgaagtgggaggattgcttgagcccaggagtatgaggctgcagtgagctgtgattgcactactgcattccagcctgggcaacaaagcgagacccgcctcttaaaaaaacaaaaataaaaataaaaaataactgatacaatcattccagaaagcaatttagcaatctccataaagtgtcttttcaaagttcatactctttgccccagtaattcactctctgggaacttatcctaaggtaataatcagaaatttggcaagaggcttatttgcaaaactgtgcattaaaacagtactttaaa

SEQ ID NO: 9650 - DNA, 1449 bp, artificial
  synthetic oligonucleotide
atctttcaagggggatgatatccagaatctttttctaaatgggttacattttatgtataagtgggttcaagaaatggacctatagtgatcttagcttatgtaattcaactcattcaaagcagtagtctgcagtctcttccaactatcaccaataaatgaagtacacataacctccttcttggattgatgctttgaatacaatctgacaagtggctcagaagcctgcttgtgccctcacattctgtcttaataataatttaaaaaaaagaaaatcacctccacgtctctccagataaggcaactaaaataacagggagaaatggaaattttactgctttttgggctttttcttttaataagataacatgataaataaaacctgcttctgtacagctatttaatatttcagaaatacgtacatgttacgtgccaagaagggaccctggtttgcttgtaagaaacaaggcgagatcacagttggaaaaaaaaacccacaaacgaaatgagaaaaaaacatacaaacaaataatagagtgataaaatcacaaatgcacaactaactatagttctgtacctacactgttagccacgtttaacatggtttgggggagcaggaaccaactcaatgcacagtcccttttcctcccaaaactgaatgagaaaacaaagtcagcacttcttaaaccagtggccacatagtaaaaactgtacattgttgtccattcatttaaaaagcaaagtcactaggatggtagaaaagtgataactggtgccttttaactttttgatgaacactttttctcagagtttgagaattatctccactctctctgcataaccaggaacaagatgcagaagacagtgaggaggtaggcctgtgccccaggacggacaccagcactgtcggctttctcattggcactcttcccagcatggtcagtggcattgtagtcaaactctgaagggcactgctgatactcacagccacttccacttccttctccactactttcatcacctagtttaaaaaaaaatggaatagaaatttcattccacttgttctcatcagaagacatacaagagcaattcgtactttcaaaccacaaatgcttactgatatcaaagaagtccacgtcgttcccattgtatgcattcttcatcttgctggtcatcactcgaagagccatgatttgacgaaggatcagtatgtctggtttgctggtgtcaacctggacctctgggttgttgccctggttggctaatccatttcctgtcactgcaaacaggtacctggaatgtaaaatgaccccagtaagatgattcgtaaagcgaaaagattttatctgtctgcctcccaaagtgctgggattacaggcgtgaagattatgaagattatacaagaggttatcaaatacttctgctagattctagtatttccactaagcaaaa

SEQ ID NO: 9651 - DNA, 1506 bp, artificial
  synthetic oligonucleotide
ataaggacacctagcttttcaatgacttatcactcttgttcattacaggaaattaatctatacagctgcatcttgtatgtcccaattgtgtttccattggggatgccccagccttttaaggtaaagaaagacatagaaatggtcctaaaaaggatacagctgtcacccaacttcaggctttattggcaaactccttttcaaaaacaaaacaaaaaaaaaaaaaaaaggagagcataataatcacttgccatttgtcagacagccccaaaagaagcggctaaactctttcctctccttccgcttatatagccctcctcctttaccccaccctttgagcacctctttcaccaaccacctgtcaaaataaagcaagccatggatctttcaaaaactgacactggaaagaagccgttggatgatttctttccaggacccgttgaaagataaaagatgaggcagacaatttaaaaggcgagactgtaccctccggatcacaaagctgaaagcagacaaaccgtggaagccaatgacacaggaaacgccctttgaccagagacagacactaggcatagcaaagttattttcaataaagaataagaaactgaattaagccatttcacaactaatagtcatagaatcatttcattgtaaaaaagtgggagaggagggagaatggagggttattacgagctcctccttttagaaacaatgacactgctttctaggaagttctgttcagatgacaaatgttttaggaagggttttgtttggggtttctttcctttgttttatttttaaaagtgagacacacagacatgtgggaaaccctcttccaatcaaaaggacagaagaaccacaagaaaaggcactacccttcaagcaactaatttgtagttcaggtttaacccactctcccaccagccaacagtttagctgtttctgggaatgttgctgaactaggtttttaaaaaccagagtagatgcaggttcctggccagaactaagaaaaagggtgaatttgggaagtgcttagagagagaaaaaaaaaaaaaacaaaacctgaactctcagaactaatgccctgggttcaacttcgtatttccttccctcccctacacacctgtaagcagaggaatttggcatgtgctgatgttagactagactttaggcataagggtaaagtttccttcctttcaaccttctgaaagaaagaaaaaaaaagaaatgtatcataaaattgaacttaaggaagttattcaacagaagccaaacacacaggaatgatcattgctgtattcgaatataaaaccaaacacaaaaaaacacacattcaaaacaccaaaaataatctaaatatccatttgtggtacatataatagattacagtacattaacttaagggaatattattcagtcatttgcaatttttaactgtataaaaccacaaaagcatttttacagttgttatattaaaaacaggagatacacccagtaatacataccaca

SEQ ID NO: 9652 - DNA, 1518 bp, artificial
  synthetic oligonucleotide
agagatggaagggacctaggccaggcatgctggctcacgcctgtaatcccagcactttgggaggccgaggcgggcggatcacgaggtcaggagttcgagaccagcctggccaacatggtgaaaccctgtctctactaaaaatataaaaaattagccaggagtggtggtgtgctcctgtaattccagctactcaggaggctgaagcaggagaatcacttgaacccaggaggcggaggttgcagtgagtggagatcatgccattgcacccagccttggcaacagagcaagacttcgtctcaaaaaaaaaaaaaaaaaaaaaagaaaattaaaaaaaactaccatgggccaggcacagtggctcacgcctgtaataccaatactttgggaggccaaggtgggtggatcacttgaggccaggagttcaagaccagcctggccaacatggtgaatccccatctctactaaacatacaaaaaaccagccgggtgtggcagcacacacctgtagtcccagctactcgggaagctgaggcagaaggatcgcttgaacccaggaagtggaggctgtagtaagttgagatcacgccattgcacgccagcctgggtgacaagagcaagactccatctcaaaaaaaaaaaatacacacacacacacacacattcatccatccatccatccatccatcatggcctagtccttcctgaaaaaagtattatttcattggtatggggtggtacccaggcattagtatattttaaaagctcctcaggtgccaggtggttcaatttcaccccatttttcaaagagggaagaacctcaccaaaggtatttgacaacaaatttgccagagttaggctagaactactcatcctaacaagccatgtcttctccatgtaaactactccatctacaacagtggagtctcttccctccctcactctccctctctgtccaactatccccacctatctcaaagtaaatatattttctgaatattctttgccttagaatcccattgcataatttttaaaaacctaaatgatgtatgtctgcttccctgtatcctcatgcttttttttccacacaaagaatcccgagagatcaatcaggcatggtttacccttaaagaagccatattgcttctccctagataggttggactcaacccacccttttcaccattattatcacacatgccatctttcaaatcccttgcaagattcaacttcaattctctgtcagcccacttaatttctagtttgtacctgggccttgtgaaacctagtggacttccctcttctggcttaaactctttgtattttgtgaaagatgcctttttccctgaagcagcctcttttactctgccagttagtcatgccgggttctttttttcttcccccgagcagttggtctttttgatgtctggcacacatttatctgggcttccaataagatgtttttacatagtttccaggcttcctggaggttattgacttttttaactctcccattcagttt

SEQ ID NO: 9653 - DNA, 2457 bp, artificial
  synthetic oligonucleotide
ccaaaaagactatgggaaatccatagggctctgtaagtggccatccagtatcttataaaaaccttcagagaccccagatatggaggagattatgatgtctcctgacagtctgtgtaaatcaactaaaagcaacattaaactgaaaataagtgcaacaaattcctggttttcccataatgattgcttcattttttttttaatttttttagtatttattgatcattcttgggtgtttctcggagagggggatttggcagggtcataggacaatagtggagggagggtcagcagataaacatgtgaacaagggtctctggttttcctaggcagagggccctgccgccttccacagtgttttgtgtccctgggtagttgagattagggattggtgatgactcttaacgagcatgctgccttcaagcatctgtttaacaaagcacatcttgcaccgcccttaatccatttaaccctgagtggacacagcacatgtttcagagagcacggggttggggttagggtcaccgatcaacaggatcacaaggcagaagaatttttcttagtacagaacaaaatggagtctcctatgtctacttctctctacacagacacagtaacaatctgatctctctttcttttccccacatttcccccttttctattggacaaaaccgccatcatcatcatggcccgttctcaatgagctgttgggtacacctcccagacggggtggcagccgggcagagggtctcctcacttcccagacagggcggccgggcagaggtgccccccacctcccagacggggcggcagccggacgggggctgccccccacctcccggactgggcggctgccgggcggagacgctcctcacttcccagatggggcggctgccgggcggaggggctcctcacttctcagagggggcggcccgtcagagacgctcctcacctcccagacgggttggcggcggggcagagacactcctcagttcccagacagggtcgcggtcgggcagaggcgctcttcacatctcagacggggtggcggggcagaggcgctccccacatcccagacgatgggaggccgggcagagacgctcctcacttcctagacgggatgacggccgggaagaggcgctcctcacttcccagactgggcggccgggcagaggggctccttcacatcccagatgatgggcggccaggcagagatgttcctcacttcctagatagggtggcggcccggcagaggctgcaatctcggcactttgggaggccaaggcaggcggctgggaggtggaggttgtagcgagccgagatcacgccactgcactccagcctgggcaacattgagcactgagtgagcgagactccgtctgcaatcccggcacctcgggaggccgaggctggcagatcactctcggtcaggagctggagaccagcctagccaacatggtgaaaccccgtctccaccaaaaaatacgaaaagcagtcaggcgtggtggtgcgcgcctgcaatcccaggcactcggcaggctgaggcaggagaatcaggcagggaggttgcagtgagtcgagatggcggcagtacagtccagcctcggctcgcatcagagggagactgtgcaaagagggagagggggagggggagggggagggggagagggagagggagagggagagccattttttttttttttgagacagagtctcaatctgtcacccatgctgtggtgcagtggtgcaatctcagctcactgcaacctccacctgtcaggttcaaaggattctcctgcctcagcctcccaagtagctgggattacagaagcctttcaccacacctggctaatttttgtatttttagtagagacagcatttcaccatgttggccaggctggtcttaaattcctgacctcaggtgatccacctgccttggccttccaaagtgctgggattaaaggtgtgagccaccgtgccctgcctcaattgtatttttgagcaaccaaatcagaagtgctttcaactacttttttggggtgctttcaaagcaaagggggtgtctgtgctttgcaggaaccctaagcatgggttgaatctgtctattgggataagtcattactgttgtcagtgaacattttgcgaccccatttagctccaaaagtaactgggcataaaatgtattctggggatgttcatgatcattttataagtttaagcttcctggaacaacctttaagcgatctattttctacttgaaaggactgagcttacagtttgatttcatttccattagaaatcagaaggtatcttttatcagagctgaggcagtacgcaactgttgatcataggatgggttgggagagatgaaacttcgtcacattggatctggggacctcaggcaagtgggtagattagagctaagatgcagagcaatatgggtacataaggcagtagagc

SEQ ID NO: 9654 - DNA, 2038 bp, artificial
  synthetic oligonucleotide
cctagagagattaagtcacttgcctttggttaaacaactaattagtgaaagattcagactcgattttgggtctcttctgtattctcctctataacatgctacttgtacaaacattttctaaagcatgttcatcaactctttgtggtttcctaagcattctgtcctcttgatttaattttttaatcgcaagctattcctcccacatggaaagcaatggagattaggaataccactagcgcaccagaatgaaagctctgcgaggacaggaaattatgtctgttttgttcatttcaacaggcttggcacttagaaggtgctcagtaaatacctgctgaataaatgaatataatgaatatatatgatttccttttcagtgatgagcaaattcttcacacataatgatagcatagattatattaacaaatactcggctgggtggagtggctcacacctgtaatttcagcactttgggaggccgaggcaggtggatcacccaagatcaggagtttgagaccagcctggccaacatggtgaaaccccatctatactaaaaatacaaaagttagccaggcatgatggcaggtgcctgtaatcacagctactcgggaggctgaggtgggagaatcacttgatcctgggaggcggaggttgcagtgagccaagatcgcaccattgtactccagcctgggcgacaaagtgagactctgtctcaaaaaaaaaaacaaacaaaaaaacaaaacaagcaaacaaacaaaacccacaaatgctccataaaatatttcagtaaaattgctcagtgaaatggtattcctctttccctcccttttcttcctttctctatcttcatctgtataatgggggaaaataacagtattcatttcataggatttttataaagataaataatacatacaaagcacttagcatggtacttaatatacaattaactctcaataaatgatagctttcaagatgaatgtgatttcttcaaatcaaataaataaggacccacataatgaggagatggaagaatcgaagacaaaagaaagttgttttatgctttaaactctgtaaaattgccttcagacacagttctctatgtgtttcaaactttgcaacttctaggagggctataaattatagacatcatctggaatgtcatagatgttttctctttttcttggagagtcttgctctgtcacccaggctggagtgcagtgatgcgatctcagctcattgcaacctccacctcccaggttcaaatgatccttctgcctcagcctccccagtagctgggactacaggcttgcgccatcatgcctggctaacttttgtatttttagtagagttggggtttcactgtgttaggctggtctcgaactcctgacctcaggtgatctgcccacctcagcctcccaaactgctgggattacaggcatgagccaccgcatccagcctcatagatttctctagaatttttctggtgcaattaatggagatagaagacataattaacttttatataaacatatgacaattattcctcaaatattgctatatgtaactttcaaaaaagatcacctctccacgagttcttgtccattccagcaaagggtgtcgttttccgccacagggctatggctgcagatgtagccaggcaaagcactatagaagctgatgaaagacttcaacttctgaattagttccctaaaagaaaaacaaaacatctgtgcataagaggcaagtaaactcagtatgagaaaagtttaatttccttatcagcatgacagaaaggctctgccaggctgattagagcaataaatgacttttaaagacattcttggctacaaggccacagtttagtttttttttaaaaatcaataaaatgatattagaaaaaaagttgactgccatataaggtgctgtttctatcagaaggatgatttaattccaacattcattttctaagacgttccacttccatttttcttattcagaatgctgttacctacattttcaaaggtgctgattacaaggt

SEQ ID NO: 9655 - DNA, 1321 bp, artificial
  synthetic oligonucleotide
gcttacgctttgctaggattagatattaaataaatggataagggtcacacatggtcccaattccaaattcatgttgcagtgcctggtcaaggtggggcgagacaagagaaaatttccagcttctattctcaaaaacctggcttaggtccgataagatagattgtcatgaaaaccacccagtgaagtgtaatttttcattcaaatcttcaaaagaaaaaaaaacagtaaaacaactttactatcttgtgtatgtatctaaatacctatggactcaaaatctgttttttaaaggttatgttacaagtaatataaattatcttgaggcttttgaaaagcatattatgtactagaatcctactctatttccctgaactgctacaataggaaaaatggtggactggccctctcataagagtctccaagtaaacaatcatcatcaatatagtatattccatggagcaaaagtcttcatgggcagtgactacagtcatttttcacagtttaatattttactaatttagatgtatctcttttaaatttaaaaggctataagagccattttctttttccttttttttttttttttttttgagatggagtctcgctttgtcccccaggctggagtgcagtggcgcaatcttggctcactgcaagctccgcctcccgggttcacgccattctcctgcctcagcctgccgagtagctgggactacaggccccgccaccacgcccggctaatttttttgtatttttagtagagacggagtttcaccgtgttagccaggatggtctcaatctcctcacctcgtgatctgcccgccttggcctcccaaagtgctgggattacaggcgtgagccaccgcgcctggcataagagccattttcaacacacatcaacgaaatttcatttctgtatgctgaagtataagtacaaaatcaaccctatgctgatagagttaaaagtaccacagttgaaaaatatgactttctaccatgtatgacaaatccctaaatgtgcctgaagagaaatgtactgacaagttagaccctggctacagtaacactaagaaaggaggaactgggagaagacaaatggctttcagttaaagcacagtaattagaaattgggtataccttatctgagactcaaaacagaaactacttaaaaggcagccttctctaagtctggaacattctctgctcccatagattagctctgtgcttatttagatgaggtttctctagcaccctctgcctcaattacttggggactcaccactcaaataaggattttagaggacacattggtccaaactaacca

SEQ ID NO: 9656 - DNA, 1836 bp, artificial
  synthetic oligonucleotide
tctcagagaatgagcagatactatgcccaaaatgattaatggcctttcaaagatgagcaagtgtgggaaacatatggctcctggagatgtgtgctttgcttgccagatggtgcctgaccccctactccatccttcatctcttctctgagattcaccccatccatgacacccattccatttttgacccctactcccaccttatccctgatctccatcctcatggctgggggatgaggtgaaactgagggctggggcatgtctgtctgttttgcacattacttggtaataaaaaattaaaaaaaagtagtggaatgttttattggtttgttttgcagctgttgtagaagcacccccatatcaaaacagtctcatcagaaagttcccagcatcaaaatggcagatcaatataagcatgtcaaaacatcatataaccatgtatataacagaatggaaaaaaaaaggcagacttgagtgctagttccagcttttaccaattgtcttccagaccctgggaaattctacttcctaatctgagcttaacttttttgaaaatggaaattttggactaaatgatcttcatagttccttctcaaactatgattctcaaactaccttgtactgttatttaactatttcatttgtgagtatcttgcctttaagcatctctgcgacaaggaccacatctcaaactttcacagaaggcatcacacaatctaagcacaaagaaggcacttacaaccatctgtcaattgcattgactaccaatttatggggaaagctagttgttagtaggcttctattcaattacttttctctgaggagcatagaacatcacatgtaaccctagttgctgatcagattctaactagcatcaggcctaactctttgtttgaaggacaagaatttcaggaacagcccaagagaatattgagtccccaaatgaatctgatgcaaggtcctccatgatctgtgtccagatggagtgatgcttccaagcgaccctgtgttcaacctcacctcctccccactgtctttcatccaattggtatgtgctaaatgtgaaaacactctctgtactatgttcaggaagaaaaaaagtgccctgtaagatactgttaatattttacattttagcataaagctttccttaaaacataagcatttctgtgaccttctttgcaaattagattttgctctgatcaaacttttatttatgctaactactatgggagacatttcttaataattcagtactttttaatctttgttttgctaaagtaacaaattaacattctacaaattttcattgagcctcaaatacatgctaggtactgtgctagttgtgaacagatcacgtctatatgcagtacatataggactaatttacacatttgttcaactcgatacaggttaacatcctggaaaacacatcagccttttatcttcctttcatgacagtgattaaatatccaggcgctcagattttttttaaaaggtatgttctaatttccttattaagaagacaagtcaccaaaggctaatctgagtttctctttcaactctatgctgccatcctagtcaagtctgattaaatagtagtgtcactacaatttggggcacagataccttactaatagaagaaactgacataccaaatagataaccgaaatttcccaatggggctatacttccttgtagcttgacttcacaagaacagtatataactgaacttttgaccttctgtactcctcccattgaaaatgatggcagctatggtagatttccgctttaaaaaatgaaggagtcacagagatgctagtggagtaaaaacagccc

SEQ ID NO: 9657 - DNA, 2346 bp, artificial
  synthetic oligonucleotide
gcaaggagacctagcctcacctgcaggtttagaaaaggatccctaaggtgttcagacagcttgttgcaggatccagagcctgaaaatgaccaactaggaactgcaatctaagtattctaagacttccctatgggctgagcttcccaaaggcctttgctatagtttggatatttgtaccggaccaaatctcatgttgaattgtaatccccaatgctggaggtggggcctggtgggaggcatttggattgtgagggcagatccctcatggcttggtgctgtcttcacaatagcgagttctttggagatctgatcatttaaaagtgtgtggcccttctccccctcactctctctctcctgctcctgctttcggcacgtgatgttgcaagctcctgcttcaccttccaccatgagtaaaagcttcctgaggcctccccagaaactgatgtcagtactatgcttcctgtacagtctgcataactgtgggccaattaaacctcttttctttttttttttgttttttttttttttgagatggaatctcactctgttgccccggctggagtgcagtgacacgatctcagctcactgcaacctcagcctcctgggttcaagcagttctcctgcctcagcctcccgagtagctgggattacaggcgtgtgccaccatgcccggctaaattttttgtatttttttttttcagtagagatggggtttcaccaccttggccaggctggtcttgaactcctgatccacccacctcagcctcccaaagtgctgagattacaggtgtgagccactgagcccagcctaaacctcctttataaattttatttttatttattattcttattcctttttcagatggagtttcgctcttgttgccaaggctggagtgcatggtgcaatcttggctcactgcaacctccacctcctgggttcaagcgattctcctgcctcagcctcccaagtagctgggattacaggcacgcaccaccacgcctggctaattttgtatttttagtagagatggggtttcatcatgctggtcaggctggtctcaaactcctggcctcagatgatccacccgtcttggcctcccaaagtgctgggattacaggtgtgagccaccaagaccagccaaactttatttatatatatatacatatatattttttaagacaggatctcactttgttgcccaggctagagtgcagtggggtgatcacagctcactgcagtcttgacctcccaggctcaggggatcccctacctcagcctctccagtagctgggactataggcatgtgccaccacactcagctaatttttttttttgtatttttttttttatagagacggggtttcgcctcattgctcaggctggtcttcgaactcctgggttcaagtggtcctcctcctcagcctcccaaagtgctgggattacaggcgtgagccatcatgcctggacttctttataaattatccagtctcaggtatttctttatagtaatgcaagaatgacctaatacagcctcgcaactagacggggctgaaaaatcactcctggagacacagcttcaatcacatcaggaatattatagaaaatgtctagctcttccattttcaataaaagtcactctcagaacatgctcagtacatacaaatttgctttagcacatgaaagttaattagccatgactcaacttaaacatgagataattcagtaggtaaatccgaaacacttccttcctactagtgaccatgttactatactcaaatgttccccctccacacttaattttctaatcttgcttcctttgtgttttgctttggagctaggtatttatctcttttctttcctgctatgctggtaatcagggcctctgaatggctcggcagaataaagaaaacaaaagtgattcttagaggggccatacaactttcttgtaagtacaaaggcacatttctactacagtttcaccgtctgtattaaagatgtctgggaaaggaataataagtgtgtggcgggggttggaaacagctacttggactgacacagaaagaattgtgcaggacagctatattttaaatgtctttttcttctgtcttcttctctctctgacctcccactgccagccgcccactcccccatccattctacccccaaaaggccctgagcattttggaagcaagatgaattatttcccttttcagagtctctagagctattttcttaagcattgtatttaatgatttgcagtgctcacgttatatttgaaaatcattcgtttttcagttgaatatgattttttaaagtttgttgaatgctttaatttttcatgacgt

SEQ ID NO: 9658 - DNA, 1817 bp, artificial
  synthetic oligonucleotide
agtaaatattcaatatgcattaattaaaagtaaaccaaagataaattcatgctgagagactagactttcacacaaaataatagctagagaacagtgaaagttggtatacggttacgtgacaaaatatgcagtgtattttctgaggtggaagaaatagtctacattctaattaggttactggttacatgggtgtacacatttgtcaaaactcatcaaactcttcacttaaaatgagtgcatcttattgtttgtaaattatatctcaataaagttgacttttaaaatatgtgatatagacaacatttgctggataagggaatgctcaccagaggctctaggagtcaaagaagacttccaggagaaggtgaggcttgaggtagaccatacagaatggaaaagatgtggagaggccaatgggtgaaatgtgtttggaaacagtggaataacggggcaaagctaacataactgcagactggctagaccctggggcgtaatagcttatcaggtaagacagacccaaatttgaagggccttgaatgcaggcagagacctgtgggcttgactcctaggcagtaatggaccactggagcttctcaagcagagacataatatgatgaagagtgctgtttaggaagattagccatacaccttgaaattgggaaatggactaaataatccctcaaggtcacttccaggtctctgattctctaattacctttatcatgttctatatgttggttattttactagactgcaattttagttaataactacaaattgtcaaaaatcacattaaagaacagaaaaaatattaatgtagaccttgatccttacacttttctaagagcagataaagcatattcaaacagcaacagaagagaatgaatcatcagggctcagtaacaatgaaaattgaaatcttttctatatatatatatgatgatttgacacatttcattgccaaggtctgctttatgaatggcagattatttttttttttgctaacaaaagtactttgtgctgaaaataataatgcattatcattaaattaatattaaacaaaagaattaatgatatcccaaactggttgcttcatgacttgtagggaaaataatagatgcctattaaaatcatccaaaggattaagtgcaggttgctctactaatgaaccaaaaaaagccataacaggcattttttaaaaggtatctttttaaatgcaggacaagtcaatttgccatccaaaaatatgaactaatttccttagcatataatagtgacttgctattggaatgacgccttttcccctaattaatcattatctaaaccacatcttacatgctcatttaatttctcacaaatcaagataggaatacagatgaaagaaatggctgcattaaaaaccggtggggaaagtgatgattgctggcgaaagaaatcatcttagggaacccagctgaaggttacccttctgttatttagcctgaaagaacatgactttgcagagggcgcacctgggtatcaggagctcagactttaaatcaaagaccgtgcctggggccaccatggactctgcctctgtaaaaggcaggccaaaatgtcactaccacactggagtactgggagtttaaagcaaccgtggagataagccattctctaagcccgaaaattaaagaaagaattacctttatctctactgccaactgtcaattaactgcctatcatttcatgcccagtaaaggttgaatccccagatcactacactctcccataaagaggttcttcctggaccactttaccaaccagtggtcaacatgtgc

SEQ ID NO: 9659 - DNA, 3656 bp, artificial
  synthetic oligonucleotide
gttctgtggaactgattcataggttgccccttacagctcctgcacatgcccacgtggtacattattaacacttaacaggggatgaggtagttcgaccctcccttagagcgaaatcctgcaaagcaatatttaacatatgcgcaaatgcatttcagtcaccaaaaagggtgaccaattacctttgcaactaaacagcaggctcactcggctcttttcatcaacctaaagaaaaggctgagggcgcgctggctgcctaggtaacctcctaccagtgaaccctggctggcagcgcccacggggtgcgcatccgcattcacaacttggtccaaccatcgggcccgcctccatgacttgttgagagccaccagccaagttttggctagggctgctccccgatccctcggaagcgcgggacgcgcgcctcactggatgcctgagttgagaagagaccctggaggccacaaacgtctcacggttacggaatacaactggccgtttcttctcagtgcacccctgacaaattaacctgtttgaaaccgactcttcttgtccgcattgtcagtgtagcaatttggtctaattggattctaaggcgggcgttaggagcccaaccgctggacagtcaatcacgcagggccattaatattcatctgttgacagcggcagccctcggctgatgttaaaatacgtcgttacggcacgatctgattgtgcagaacaaaaggcaggcgttcagaaactttcctccacctgaaatcatctcccctttaggatccagcctgtcaagaaggcagatgaatttgggagggggaggagttaaatatctttggactcctgctccctgggccagcagcaccggttttaaagcgatttcgctaacctatataagggatgctgttttgaaggaaaaggttcagtctcctcattttggggaccctcttactcaaaagtttgcctcagtgtgtcttcacccgccactgcagactcagaaatctgtcctcaactttgcttgcacttgggcccgtgagcttaggaaacccaggctgggtaaaggcggcggggggtgggggtacgttggggaagggatggctggagctgtggtccagctaaggctgaaattctgacacgtatgtgcgagcaaggatggcaaattcatgaggcaccagctcggctgtggggcgccagttcgcagagacccgggaaaatagctcccaccttctcgcccttccaaaaaacgggcgctcacgagaaggcgatccccacggttcctcccgctcacaccttccctgacagcagcgtgagactgggggatgtgggctccgtccacacacaccctctctccctccctcagtagacccagccaggccccaggcacaccgaccactcccaagtgcccagctgcagggcgcacgactacagcccggcggggctagcgcgctcagggtacagccaccacgcgcgccttgctccccgctgggcgctaggcacgctcaagggacccctcctcacctggcacgggagtttctggcacccacttgagtccgggctgcagtctctggaagaaggagcggacttggtgacaggtggcgtccggcggcggcggcgggggctgcgcctgtcccgggaagtccaagctgagcagcatcgccaccaccaagcacgcggtgcgcacggtcccggccatcctgcttcgcagggagctaggagagcgcgggagagtggcagccggagcgagagcagtcccaggactcggcaagcctggcagtggccctgaggagcaagagacgtgctgctacccagccgctgcaaaagtttcctcgcagctacctgggcgctgggcgagggcgggaaccgcttggcggcgcggggcagggcggggctgactggggtggggcggggcgaggagggacggggcggggcgaggcgagccgcgcggccagggggcggtggcggttgtgcggccggtagccggcggggtgcgggggcgcggcgtggagcgcggcgggggccactggggcaccgcggcgcggggaccgggcgaaggcagtgcgagaggagggtgcggagcccgcgcggtggctcccggcagccgagcccagctgcccgctcgcagccgctctacacagggcgctctggcataactactgcagaggggctgcaggctcgagcgcgctgattggcttcccagcagccgtccgctctgactggctctgggagaagttccccagcctcactcctccttcccgccgctcattggcctacagcctggagggcttttccctttaggatttttgtctccttttcatccttcctgggggcaggtgggggtccctgacttaggtccccctccgcttcgccacaggccttctttcagcttgtgccagctctttcctggccaccagagccacacaaggtgttccttcacacaaaatccacctcctcattctactctctgaggagcttcccgggaaccgttttcctaacgcagctctgaccgggttctcaaagccaacctgcaaatagtcgcgttcagggacagccagggaccgctgggcttttcacagcctgcctcacctttgaatattgtatcttaaaagtctgaaagcctctgtggcttgctagatttgattcagtagagccacacaaagtcagagaaagcacctgattctggggcgttaaaagaaaatctactgcacgacagtcccaggtggcccttcaagaggcaaagcctaactggttacaacgaaataaccaggggcttaaagccagcctaactcattagaaaatcattacacagcaaatttactgagccaaagctagcctatttcatagatggagtagaaggctatttgaaaggtatcctacacccaaatcccacctctcctgcttagatttcaccattagaaatccagttctttaggccaggcacggtggctcacgcctgtaatcccagcactttgggaagccgaggcgggtggatcatgaggtcaggagttcaagaccagcctggccaagatggtgaaaccccgtctctaccaaaaatacaaaaaattagctgggcgcggtggcaggcgcctgtaatcccagctactcgggaggctgaggcaggagaatcacttgaactcagagggcagaggttgcagtgagctgagatcgcactactgcactccagcttgggcgacagagtgagactccgtctcaaaaaaaaaaaaaaaaagaaaaaagaaaaaaagaaatccagttctttgagaatgaaatatctctccaaggaaaaatgcatttagtcattacctatatgctgctaagtagggatctttagcgtggattattttcatgatcctccacaccctagtccagtagagaactcaataagtatttgtatgatgaaattacttaacacctcagcatgaattagtttgtcatctgatggttttgtttccgacctaggtgaaagtaggttttgagggagaacctcagcaccaggaaattgtctggggtgtgcaaggtccggagagaggaggttgtgttccaggacccatgggctgagaagggagacaaagagagaggaaggtcacgggggaagttcattcatccatttattcattcggtaacaaatatttgaactcctactgtgttccaggcactgtagattacaa

SEQ ID NO: 9660 - DNA, 2035 bp, artificial
  synthetic oligonucleotide
aaaagtaagacaaagctcctgccttcaaggttctcacaatccatagagggagacagacaagtcaatatgcaataatgcagtttgataagtgttatggtggatgtatgtagagagtgctatgaaagcaagagaggaaggacatcaaatggaatgagtgtaaagtagaaaggcagggaaagcttactggtaggggcaatatgacagagaggtggagaactacagtggccctgagaacacaccatgcaagcctccaactatggcagggtttctcaaccttgtcactattgacattttggaccagattattcttgattattctttgatgaggggagctggcctgtgcatcataggatactgagcagtatccctggcctctactcattggatgccaggagccatcctccccctacttgtgacaagcaaaaatgtctctagctgttgccaactgtcccctggggggacaaaatcagctggttgagaaccactaaattacaggttcatcattgatcaagagcctcaactgctgtgctctaaaattcattactgtttttgcacaatgccacactttccatgggctgtttctagccaagggactgagaacagcagggacactaaggcaatgctattgtggggagatgcagagtttggctcaaggacttaaccttaccaaacctttctttgactgcatgacaggctaggatgccaccacccaccatttctttcttcctccttcaccaggggtcagacttacatcagtctgatggttgtctctgccttctctggctccccccaccatttgctctcatactgatatttcccttactgaaatccttgaacatttaattcctttttgctttctgcttctcagaggacccagactaacattagaggttagactctgaaatcagaaataccagaatttaaatcctggttccccttattagctgtgcagccttaaacaagttaccatacttctctaagcctcagttcactcatatgtaaaatgagggtaacggcatccaccttagaaggttgctatgagcattaaatgaactactggatttaagatatttagcatggtgctggatagcaagtaagagcccaggaagtcctgattcttagtaaaggatggatatgtggagaaagaggtgctatgaatagagtgatactgtgatacataggcatgatggtgagaaataccatagaaagattggaagggatgtaaaatgttataagcattttggtattgctggaacaaagtgcaaagcaggaagtgatgagagatcatatgagaggtaggcaggtcccaaaccaaacaattccaaccacttgagacagggtctaactctctctgtcacccaggctggagtgcactggcgtaatctcggctcattgcaacctctgcctcccgggttcaagcgattctcctgcctcagcctcccaagtagctgggattataggtgcctgccactacacctggctaatttttgtatttttggtagagacagggtttcaccatgttggccaggctggtcttgaacttgtgacctcagatgatccacctacctcgcctcagcctcccaaagtgctgggattacaggtgtgagccactgcgcctggcccccttctacctttttaatgcaagttatattattctatcctttcatcatctcctttgagccttcttcaacttcactacatctgcctttaagctgaaaacccaaaccttcacacaaacgccatccaaattctctaattcgaatggggctgactagtttggagagagactaaagggcttgttgcttcacagttcctcccctcaggattccaatttatgcagccttgaatggggattacttggagggaaaaagatctaatcgctacttggcccttgccctgaaaactctttcattcaatccaaaaacattaacagggaccactttttccctaacgagagttaatcattactccaacctcctactctgtgctctctcctcccaccagcacacacatgcaagaatcatccagacatgcc

SEQ ID NO: 9661 - DNA, 4245 bp, artificial
  synthetic oligonucleotide
accaaagtaggcagattagctcttcttcccttcatgtcattatcttccataagaaaaccttctcccatttccaagtgcttattttacctaagaacatacagcaaggaagtgagcctctatgtgaaaaaggctcacagggtcccctatctcttccatgatggggtaacttttgtttaaaagaaaaacaaaaacgtttgggacagaatctgtaatacgttaaacgagtgagggaattttaaatgttgaactttcgtcacgatatcttatgccactaaatgagtctttagaagtctttacaaactaaactgatttataaaacttatacatcaatctggaatcaattttctattagggaagaatggatttagtatagaaatgagaaaaataacatttttccccttaaattgggtttctacacctgtgaagatttcttttccattaaaaaaaaaatactccaaacttgactcaaaatgcatagtatttgccaacccaacctggccaaactgagccccacagccatcagacagggcgcccttctagttactaccttttgctaattagcggttcatctggcatccctcgcgcacgctgggcagtcactctccaatccccttaaattgcaaataataataataataataaggaaaagaaagaaagaagtccttccctgtacgcctttgtggctcccttttgcctcttcccgcgtctctcacacccttacctaatgctcccgttgaagtccgcgagcagcccgcgcgtccagggtgtgctccagctgctcacaccacgcgctccagtcctcgtgcagcctcagccgccgccgaaattaaagagaaagaaacaaagcatcatgggaaacggagttctccattcaaagcaccaaaaacgcgccaagcccacgcctccctccccctccattcccgggttggtgggatagaagccaagagggaggggagtcccttttttccctccacgtgcaccccctcatttcacaccctcaccaccaaagttttccaggaacctaaaggtcaacggtggagaagaaaaggggagtcgtttcccgcgcgctgcccgctacccctcaaccgcactctggtactttgcttttctcaagtcccgcccgctccgtcccctcccacccaaccagtcaactctaccggatcacagctgccccaacgaagggctcccttcttgcccagccacccgctcgggaaaccgcgcgcgggacccagctccggcccgcccctcgcaggtggagagcgcggggatcccgcacgggccgccctctccgggtgtcccctccacacgtatacccagtgtcccagcgcgcagctcgagcgctccggggccgggtgcgagcgcagtctcccgcggagccagaaggggaagagaagtgagaaaaagcgtccactaaatggatcaaggccgcgagcgcacatctcaccccaaagcgcccctgtccagagcgacgcggggccacgagcctccctgccaccacttgaggagcgctccgtccccttggccctctgtccgtagctatatccctgggaaaagcccgcccctctgcctttaatagcccaaggaaaaaagcccgcccccgcccacccggcccgcacaggaattaggaaacggaacccccaccccgccaaagcgaaaaccccaccgagccccagttacccacgggcggaccgcagtcggcattttcccttctctcttcccccaagctggagtccttaattaaaggcgcgcctgggacagcggcccaggcagaggccgtggccggagccggtgcgggtgccaccggcatccgggccaggatggcgcactcactaccaccttgtcccatctcgctcccgcggcgctcgcctcagccccccaccggagacagacgacgaggcccacggagccgtgggacaggggtgtcccccacccggcgcgcgcatgcgcgccacctcgccgctagattgaaagtgttcctaaggcccgaggagggaagaaatagaaacacgacttactctctgcacatgtgaaagttttaacccctagcaccttgtgctactgttgggaggctttcgcccttgccaggcgccctcttcacccactaaatcagggtttcttggcaggtatcgttaacggtagcagccaccgaatacacgcgcaaatgtgcggaagatacggtgcaattatcttgctttctcctctcattccaccgctaatgagaaccaattgagggcgggctgcttcaaggccaaagcccgacagcgctctgtagaataaaatgatgtcttagtttaagacgcacaatcaaaatggaattaagcataccagactttgaacaccgggcaaaatgagagacaaccgggctatataccttctccgcgtccctggcggacacaggcgcaagatgggatttggggagcgtgcgggggttgggggggtgggcgggggtgtgcagggtacgaggttacaaatcagagaccagtgagcacgctgggtcggaggaggaaagccctggaaggcaagcggggggcaaggaaggagggaaggggtgcaaaatgaagccggacccctccctttccaccattgttaccagggtgattgtggcagcccaaagcccagaagaggacaagggcgccatgtgattctcaacctggtgcactggtgcacagtagtagctcaggcaaacattacaaaagactggcctctcccgcccctggcccgcgaaagagtccaacctgaactgccagcgcccctcaggagtcagcggtggatgcaacgaaaaccacaatcatttctccaacgcgagtcactcgcacaggtgggcttcctcccctttttcatgcaacagaccttgcagcctaccctggcacgtctgcgtgatactttctggaaactacgcagcccgaagtttactacccaaccagatccctcctgtgagattgcaccgactgcaatgcaactttcgacctttaatggtaacgactagcagtggaaagaagaggagggggagggaagagaacttagacccgactttaagaagcgttgtattaaagcaagataagaacagtacctttgagctggagcaaaacctggagtaaaaaaaagggtttttgcgaaagtggcgcgaagataatatcatgtgatccgaccccagggcgtctccttccccttttgccaaactcccctcccctcgaaaaaaggggggttgggggagctacatccgctcctcacaaactattagcataattaattgtgtcctacagctgcagccagagctcccgggtcaatgagtaaacatatcctcatcctcttcaacatcagaacaaaaaaacccattaccctgattttggaaaatgttcccaaataaatctcattatcttcaaaagtctttatttggtattcggagtctatgtgtcttggttggagagacagaagaaggttggaaaagatgaaatcatcctattaaagggaacaagtagaagtaactccccaagagtgacatatttaagtaaaggttttcaaatggaaataccgtgttgagggacttcactagcttaaaattttccaaaagttttagcagttcattaaacaagacatcctcccagtcttcctattcgccaccccccatctcccacccctcctcccagtcctccttccctttaaagctagaacaatacccggaataaggtattttgagattgctttaccaggatattttcttgttcttaattttttttaagggtttgcaacatatagaatgtctggatcaagttcccaactggcgaaaataatttattccatctcagtacctgtctagcacaaggtaaaactaactaagtacaagatataggttatgagaaactaggacattttgatacaccaaatgatttatttttgtctctttcttttggaaaaaaaatttaatcatcggccaaaatacctagagaatcaaaaaaatctaaagaacaaagcatttcacacacaccccccccaaaagtcagaataactaacagctcaaagaaaagcacgtgatcccttcatgctttaaaacttgtggtcatgctgaggctaaaagcaaagagcttgtgaccccgcaaccccgtcccctcccccagaccacagcccagggcttaaggctccaggctcccaccgggctcctgctcgctcccagtattgtgagacaaacaatacttaggcattctgcaaaataaaggagccacaactcctatcccccagtcacatcat

SEQ ID NO: 9662 - DNA, 1415 bp, artificial
  synthetic oligonucleotide
agttgcccccaatgggttttaaattcaagtagggtgcaagagtggtttagagaaattcctgagtggcaaatgaggaaaccatgggctctctgagatacaagcccagtcttccgtaggggcatagccacggcacaatgctctcctgacctaacgtccttaaaaccttggtcagaagtcagaccattgtgctaatgcgtgagggtgtgcgtggggatggagggtggggtggaactcctgcatagttagcaaccctgcaccaaatcctggcaaccttccagagcaaaccctccaccatgtcatgctaataacagcagacctaggaactgaccctatgccacgccgtctggacccgcatacagtcatagtgtccaggtggctttgtgagtcacccagaccctccgaaataatcccactgcgggtggggctgccttgcagtttctggccccttcccaccctgactcagctttccttccacgagctcctatttcttgccgggcagaagccgccgcggtacccgcttcaccgggcatgctcagtcctccggccaggctttgactgcgggacgccagcgtccggccccctgcgcgcgtccggagtccgggtccctttaaatcgggcaggctcgttgctaggcaaccgcgcggcccgcgctggcgctgcactgcggtggctcagcccggagccggcccggcggggtcgcggtggccagagccgaacggggggctgccgcgcgcgggtggtggttgtctttgaggaagagaggttcgggctctccagacggcatccacgcttccaggtatgtctgcggacgggaaagcccgggctcccccgggctcgcccctcttcttcccggacacagggggcgaaggggcggggagccaggggcaggcgcccaggtccgcaccccaacccccactgcaagttatttctgtccttagagccccaggccggggctggagagcgtttgggagggaaaggaccaggacgtgggagtggcagtgcggaaagaggagtggggtcaggcctctcccgccgcccgccagcgactaggtcgggactggggaggtggaaagtgtcacctgcaatggggaccgaagcagcgccccgaccccgagccaccttctctcctcgggaggcaacgatggcaggagtttcagttaacaatttacagagaaaactcccaaactatgcatacaaagatacagctttgtagcaagaatgtgactctcatactaataaagtctcagccttcggaattaaggtgactccccgtatcttttcttctagaaggaataacttcacactaataacaaagaactggggagtaataagcattcacggggcccagttttcaatggtacttttcttccccctcaatagctgccaagcaatagagaagacaatttgtcccggga

SEQ ID NO: 9663 - DNA, 820 bp, artificial
  synthetic oligonucleotide
aatgtgttgaaacatctataaactccaacctgaacagcccacacacttgggtaacagtgtctgttcctggcatactcagaaattactggacagtctttgtagcagattcaaattcctatctttctgcagtcttcctgctgtctaaatttcttaactgaatttgaagaattgtgtggattcttatgatctactacaaaacatggcctggtcccagaccccagcactaccaagttctgatgtaacttacctcatcttaaaggccaagtctgcttctaagcctgcttcccatcaagtctttttatgtgtgccttatttgtaccaaaagtgggttgtcagtattggagccacgagatttccatgctgactggtatgcaactaacaacataggaattattcaagaaaaaagaaattagggaataatagacacatcctgaacttcatttctccacatgtttccgtaggacagctatccctatacttccaactagtgaagcctctacacctaatagtaaaaaacaaatatgggcaccgtttattgaataggtactaggtgcttggcacttaacacaaaaccctatgaggtagataatatgagtaccactttaatattggaggacatgaagctcagagagggtacaatacttgctgaagattacagagttagcttgtggcagaacagggattcaaaactacgtctgtctgattggtgacattagcaagatggtagactaggaagtcccattctttgtcttgccatggaaataacaaaaagctatgatatttaggccaagatacctttaggagaactccatagtcaagt

SEQ ID NO: 9664 - DNA, 2260 bp, artificial
  synthetic oligonucleotide
gaaaagagtggctgtagaacattctctcatatgtgtatactataatttatttaaacatttttctttttctttttttcttttttttttcttttttttttttttgtgatggagtttcactctttttgcccaggctggagtgcaatggtacaatctcagctcaccgcaacctttacctcccaggttcaagtgattctcctgcctcagcctcccgagtagctgggattacaggcatgtgccaccacacctggctagttttgtatttttagttgagatggtgtttctccatgttggtcaggctggtcttgaactcctgacctcaggtgatgcgcccgtctcagcctcccaaagtgctgggattacaggcgtgagctgctgtacccggacctaaatatttttcaattgttgataggtggttttacattttagactgttctaaataattctacaatgaatgtgcttgtgcattaattgcttgagtgtgattattttttagactaggtttatagagtaaaattactggcttagagaatacaaattttttaaaaaccttgttgaataaggcaaattgcattctagagagtatgtaccaatttccagctgtatacaacagtgcccatcttaactgtatcttgtcaatgttgagctcaatatagtattttaaatggcacctctcttttcagttttgctcgctaattgaatttaatatatttttttcaaaatgtacccatctaaacctgttttggatgtaagtttcaagataaactactttccctaaagttcttagtgaagtgggataatgtttgatgcgttaaaaaaatagattgcaaaatagtatgtgtagaattacgtttcactaagcattgtaacactgtgaggcatctctgcttggtgagtatgagtgatttaaaatttttctttgtgcttttttgttttccagaatttctttaatataatagaactttgtaattaagctacagttcaaatgctgtacctccttaagaatttataagccatccaaaagctttgccttcttgataatttggcatagtatttctttttacagtaatactttgaagtttctgtatttatttaaggaagaaaggggtatttcttgtatcaataatgggcactggccctcatgttttctgggaaacagctgtagtgagactgtttctgtttctgacatatgaatattttttaaatgatagcctgaatgagagttttagtgtttgacttgcttagagaaatgtaagaaattttattggaatttatattagcctcttggtacaccaatattgcttagaggccgagtaatccaaaagttaggaatgctaagtgttctttatgttcaaattaataaaaagagggatgagaacactttagaacaaggtgtccagcaaccaagaagcaaatgaacagttttttagatttagcttgttgtgaatctattttggcatgtcatgtacagttaaatggcctcattataaaagttcacttggtacagtacattatgatatgttaatcaaaaccactgaaagtcattgttatgtaactttttaaagataacttttttcctaaatgtagagcatgagctagttaatcaatatgaattatccattaaattcaaaaggtaaggtataataaaatacattgaaagaatctgttcttttatctgtttgcctgaattcatagtgcaagaggtaagtgacatagattaaattgaaatactgtgcatattttcataatataatcaacttgacatcacaaaatagtctcagagctcaaggtattaaaaaaactacctaattctttcaccttgtctccttccctcgctttaaatggattttactaggttctcaaatagtaagttatgtgagatatttttcccacagagtctcattaattaagtggatttttttttttttttttagacggagtctcgctctgttgcccaggctggagtgcagtggcacgatcttggctcactgcagcccccacctcctgggttcaagcagttatgcttcagcctcccaagtagctgggattagaggcatgcgccaccacaccccagctaatttttttgtatttttagtagagatggggtttcaccatattggccaggctggtctcaaactcctgaccttgtgatctgcctgcctctgcctcccaaagtgctgggattacaggcatgagccaccgcacttagcaattaagtggaaattttaaggaaaactttttttttctggtatgagacattttc

SEQ ID NO: 9665 - DNA, 1352 bp, artificial
  synthetic oligonucleotide
cagatgatttctcacattggaggaacctggatgaagggtacatgtgaaccatctgtattctttttgcaacttcttgtgagtcttaaaccgtttcaaaataaaaagttataataaaaaggaaaagatgccgggcaccgctgggatctgtagtcctagctacttgagaggctgaggcaggagcatcgttgagcctaggagtttgagggcagcctaggcaatatacagcgggacgacatctctgaaaaaacaatgaaatgatgatttcttcaggattacaaggtcaaataggaccaagttcacttgagtgggcaaccatcaaagctgaggacactgacctgtcttcagtgggcatcagctgcacaacttcagtccattgttatcatgggaatgtggcccagtgttgcaaaatcttgcaacttttcaatagaagccagaacgttggaatctgggtgttttttttttttttaatgtgaaatctttcagtgtgcaaaacaaattcaaaaacatttttaacactgtaggccaaaccaaacacatctgtgaaaaatctgagttccatcaacccctgctattggttattcctcgtattcatgtgaaactttgggagttgagagggaattggtatttgcacgttgtatctctgaccataaatttaaatcatttacaggtttacactgaaaatgatgtatttccaagttcacaataaattatattcattctccgtagcatgattaggagtaaagtagtgtgcttgagaattccttaccttatatggagacttgtttaggcccagccaaccaaggctgtatgtgtgtgtgtgttttaatttctacctttgcacagcttgcctttacccttgctgtttaggtatttgaaatctttaaaagaattttgtggccgggcatggtggatcacgcctgtaatcccagcactttggtgggccaaggcgggtggatcacctgaggtcaggagttcaagaccagcctggccaacatggtgaaacctcgtctctactaaaaatacaaaaattagctgggcatggtggtgcgtgcctgtaatcccagctactaggggaggctgaggtaggaggattgcttgaacctgggaggcagaggttgcagtgagctgagatcgtgccactgcactccagcctgggcaacagaacagagcgagactccgtctcaaaaaaaaaaaaaaaaagaattttgtaatggattttatataacacatgtttttgtttttctttttagttttaattcacaggtgttgcaagctgacatgttaagaattaggacaaacagaacaacatttaggaatcgacgctctctggtaaggaaatgcttatagtggcc

SEQ ID NO: 9666 - DNA, 3916 bp, artificial
  synthetic oligonucleotide
atcttctcatgatttcctggatgaagtttttcagtgggaaatcctaagcctttgcctgaacctaaattggttccttcccatcccttaggtataaattaaaaataatctcttctagggaagtctttcatcattattttatgaaggaaatttgccataccatgttttctcacttataagtcggagctaaatgataagaacttatgaacacaaggaaacaacagacactagggtctacttgagcggggaggatgtgaggagggaagcagaaaagataactattaggtactgggcttactacctgggtgatgaaatagtatgtacaacaggccaggcgcggtggctcacacctgtaatcccagcactttggaaggccaaggtgggcagatcacctgaggtcaggagtttgagatcagcctggtcaacatggtgaaaccccatctctactaaaaatacaaaaaaattagctgggcatgatggtacgtgcctgtagtcccaactactcaggaggctgagacaggagaattgcttgaacctgggagatggaggttgcactgagctgagattgcaccactgcactccagcctgggtgacagagcgagactccgtctcaaaaaaaaaaagaaaaaatatgtataacaaatcctggtgacacatgtttacctatgtaacaaaccttcacatgtacccccaaacctaaaataaaagttaaataaataaaaaattaaaaaatagaaagtaattgtcttatttatgacatgtcattataatacagccaaagtgtcataatttctatagaaagtatatgtatacatttaagttcaggttatatatctttttcattagattataaactttataaaccatagtgtttcatgttatatattgtgaattttctgggcatttgattgatgcagatgtgaaccttagtagcatgaattaaacgtattaaaattctgcctcttcaaaggtgtgtgtgtgtatctgtatatatgtgtatatatatgtatatttgtatacgtgtattctatgtacatatatacatatatacatacacgtatacatatatatgcatatacatgcaaaatgtatacatgtacacatatatatccatgtgtatatgagagtttttcaggaaaacctaaatttttcagattctgttcatgccactgcacaacttctcaattagtgttattaaagggaaacactgaggaagaatctccaacactgtataaatcacaatgttttctgcttgctttgaaagtttgattatttttatagtatgccttaagaatgggcacgtaaatattttttaaattagcaatatttggggttcaaagtaaaaaagaaaaaaaagtcacagtatctaatgttgagagggtatgaggaaataggtattctaatacactactgggaagtaaatttgtataagttttctggagggcagcttggtgatatgtatcaacaaccttgcaacccagaaactccagctctatgaattgatcctaaagaattaattaaggatgtgcacaaacattagcttaaaagatattattacaacattatttataagagctagcaaaaaatatggcaacagcctgaatgtctaacaatagggaataggtcaatcgaaagagccttcgttacgtgtatttgaattccagttctagcaatgactgcataaccccttggacaagttgcttaatcactgtagccctcagtttttctgaggcaaaatgaaggtgataataatgcctacctcatggggttgctgtgagaattgagtgagataaaacgtgtggcacataataaaagtgctgcttattattatggtacgtccttacagtataatattcagcacttaaaatggtgttgcagatgaattttaacatggaaagactcagaatgtattaaattatatatattgagtatatatgctttataatgagaaaaaatgtgagcctatttctgttaaaaacaaaaagatcagggccaggcccggtggctcatgcctgtaatcccagcactttgggaggccaaggcgggtggatcacttgaagccaggagttcgagaccagtctggccaacatggagaaaccctgtctctactaaaaatataaaaattagccgggcgtggtggcgcacgcctgtaatcccagctactcgggaggctgaggcaggagaaatgctttaacccaggaggtggaggttgcattgagccaaaattgggccactggccactgcactttagcctgggtgacagactgagattccttctcaaaaaaagaaaaaagaaaaaaaataaaagatcaggacaaacaggcagagcataggggaattttaggacagtgaaactattctgtaccatactataatgatggatgcatgtcatacaaaacccttagcatgtccaacaccaggagtgaacctaaatgtaaactatgaactttgggtggtaatgatgtgccaatgcaggttcattggttgtaaaaaatgcaccattctggtgagggatgttggtagtgggagaggctgcacttgtgtgagagccggaggggggtatgtgggaactctttataatttctgttcaatttcgctgtgaactgaagagtgctctaaaaaataaaatatattaaaaataaataaatgaaagttcaaataggaaaagactggaaactgctgggtaacaggggacagatagcctagttttataaatacttagcatataattcaaattgtttatgtatcattaaaggatgtattctagagtgtttgatgatggtagtaataatggtggtagtagtaatagttaccatttatttagcacaaactctgtgccaggtgctgtgctaaacacattacatgtattatcaccattatcacattaaatagatgcttaaaacagcaactctagcatgttgttcataacactattgcctatagcaacaaattatatatccaatgtatccctttaatataagttttatccagaaaagatttctgacttttgttagaagggtcagctagtagcattattgatttgaattacaaatttccttaagatatcaaccctggaacatgattagtacaggccagtctgagttatgcgccagtcaagagtccacaactgtcagattttttttattattattattttttgagtcagtcttgctctgtcatccaggctggaatgcagttgatcttggttcactgcaacctccgcctcccaggttcaagtgattctcctgtggcagcctccagagtagctgagattataggcgcctgctaccacgcccggatctttttttttttttttttttttgtctttagtagagatggggtttcaccatgttggccaggctggtcttgaactcctgacctcaagtgatctgcctgccttggcctgtcaaagtgctaggattacaggtgtgagccaccgcatccagagtgacatgtttatacccattctctggatagcaatagaaccaggctcagggctgatgatatgtatctgagtatatctattccaaagttaaatagatggtgctattaggtgtaacctgctcttctcctatgtataacagagtagatcattttcccacagttcaaactctttgagcatgacatttaaagctttctaatatcttcacgcttttggcctcagagtcctttctccctccacgaacttggtgtgccactcacacagggccagtatcctgtcttaaaacatgccaagcactttcacttttctgttgcttatgctggcaaactccttgttctgaaggtccaactgaaataccaccttatgcctttcttatttgtcttccacctcccagcccctacacacacccacttcatctttgctttttattcccaccccactttgctttcatttgacatgcacttccttgtctcttat

SEQ ID NO: 9667 - DNA, 2013 bp, artificial
  synthetic oligonucleotide
cttgctagctacggtccttagggagcatgggctgacatggcggaagagcaagactgtggggggaggggacggtaggaatgcgtctctcccactcttcccagtctccaaatgcaaagcttgcagggtgccctcaggtaggggcaggggaacacgacggacagcaggagcagggagagaccagtcctctggccccaaagacagggcaggaggcagttttgccaagggctgtgcaggagctgcagagagacccagggctgagggctgagaagagaacagacgtagggctcggcctagaagagaaccgtcctccctatgcccaccgactggtggggaagagaagggtgggggcatcgttgctcctctagggccttcccggggccgcccccagcccactaccttccattccccaggtttcagtggacaccctgggggcctctgcggaaagggaggccggcactggggaatgagcgggaggcggctgcccctcaccctatcctgcaatcatgactggggaggaggggagagcctgcggctgcctttcctttccccacctgggctccacagctcttcgggctggtttgctccggtgccttccatatttccccccaactgccaaggcgccccgacctctgcagggcagagccacagcccctcccccattccaacctgtcgcctcctacctttctgctcggggcggggaaagtcaagtcgccgcagcagaattccctccttctggtttccccctcttttgccaatgtgaggcaacaggtagtccgagctcaggtagtttctggagcccaattgtaggggcctgttcagtgcatttctgcgcgatccggggtcccgggctgagaccgcggccagggccagggctgggccttcgtgcccgggcggcgtaggtctagagtccaggggcccgggccgccccacctccgccccccgccgcgatccagctgtccttcatgcccgcgacccggccgggggcgggcggggacactgtcgcccctccagccgggcctccgcggccgccgccgccgccggcgctcactcgatccgcacttgcaggcggacgttgagcatcaccgaggccacgatgtagaagtaggggaagttcatgcgcagccgccaggccaggtcgaagaaggtgagcagcgtgcgcgtgagccccttgcagaaggcgccgtatgagcctcgggccgccgccgagcgcgacagccgaaccgccaagccagacagggctgccgccgccgccgccgcagacagagccgccgacgccgccatgggcccgggccccgcgcaggccccgccgaccgatcgacccgcaagagctcgagcctcaggacggcgggaccccaacactagcgcgccccgccggccgccgggagagcgacgtccgccccgccctcgccccaccctcgccccgccctctccccaccctcgccccgccctcgggttctccagactgagccttgcttcaggggccactgcctcggtccctcctccacgagcccgcacagctccatccgctccacatcacgtcactgcgggccccgccccccagcatagctccgcccctaacagcctcgcccccggcagagaggccgtcggcgtagcggccccgcccactagacccgccctgcattctcagctccgcccaccgcccggttccgcccacaaagccctgcctcttttcgggcgcctcccaaggcaggagcggattgaagggcggagctgccagggatcgattgctgtgacactgtctcctagggtggagcaggagtggaggaggacagtctggaccgctaagctgattctgtacagaaagcacatgcagaagactctgcctgttcatatcactccccttctcccacggtctcccctgaaaacttgccagccaagacctttctttaattcgcatttctctttaatgcgcatagtgcagtaattctgcgctaaagagtgccaccaaacccacaagcgtgcatttttccctttctgttgtatttgctggtc

SEQ ID NO: 9668 - DNA, 635 bp, artificial
  synthetic oligonucleotide
ggtaactgaatatctttcaagaggtcaggaaaaaagtacaaagctaaagaatgaaatctagaacgaaggcataaggatgtgtctcacataacagtcgccattttaaagattctttctggttgtctcactcccaaatttttgcttatagatcattagaaagatctcggtctcatggtcacctgagctataagaaaaactggcaatgtggtatttgagatgggcacaatggtatcttgagtaaaactggacttagtgttactaagaaagaagtataaaacatatcatctagataactagcagtctttgacatactgacatattatttcatagtgttttgctaaagacaaaaaagaaaaacaacaaaaaataccgcttgagtctttagtttcttagtgtagcacaagtgcttaagcagataaatacgcatgaaagtgctccgtaaactataggtaaccatatgcatgaaggctatcattaccaccatgaattttttaaagatcagggtagacatcatctgtgctcccttaggggtttgtaaacttagaaaataattacatagatgctgcattaatttgagtacgaaataaaagcaaaactaaacaaacaaaaccagaacgaataatcctagattttaa

SEQ ID NO: 9669 - DNA, 1945 bp, artificial
  synthetic oligonucleotide
ctgggtctaccaccctgctcccatgaaagatggcaggcagggggcaacacaggagggctgggtaaccctaggaaaggagctacaggataataccccaagcacctggaaagatgatgaaagaatgaaaaccacagcacatttgacaatttctttcaataaccatttatggagcaagtactttgcaccaggcattggttataggctctagctgctctcaaggagtttacattctagtgcaagaaacaaacccatggcagaaataacctataacacgaagaggctgatgttctgtagcagagaaagatgtagaaagggctttgtatggtttagtgttgatgtatgccaaagaaacacagtggagaagtctacacaatttctagcataatacagaacttactttcctccaggaagtgatgaagagaaggttcttggtgacagcttggggattggtttaatctgaataagcccataaatccgttacatcatttttgtttttgttttttgttttttttttgtatattgccatttttgtagtttatactgagacacaaatatttttcaattctatgttgacatcatttcaattccatttgcatttatgccagaaaaaatcaataacatgtcttgttagaaaaaaaaaaaaattaaaaggcattcacctgcatggggagaatatcttgtccctagaaggtcactctgtggcaccatgcatatccttgaccacaggagcattgtgtgactgagactatttgtgtttcactaatgctggtaagccgtttttgaaaattgtctcagtaatattcaagttggaagaactttttacaattcttttaatgtaatttttaacatagccccttttctgattataaaagtaaggcacactcattgaaaagttgggaggaaagtataaaggagatattttaatgtcatcttaaaataccatttgtaaactggggtatatcatggctcagcagtccttattctcctctctcatacacacatacacatatagatattcacaaaataaaatataaactcctcataggaaatcttgtaattcttcaaccaaaggctagtctaagcaacaagtcaacccaatgcatttattcggtgggctgaaagtttgtacagtattactcaaaattgactttaacaggcagggcacggtggctcacacctgtaaacccagcaatttgggaggccgaggtgggtggatcgcttgaagtcaggagtttgagaccagcctggccaacatggtgaaactccatctctactcaaaatataaaaattagctgagcatggtagcacatgcctctagtaccagctactcaggaggctgaggcaggagaatcgctttaagctgggaggcagaggttgcagtgagccgagatcatgccactgtactgcagtctgggcgacagagcaagattccatctcataaaaactgtgaactaggcaaagtttgtttccaggaaataatcacatccccatcttaataatcccatccctatctaatattaggcacaattcttagctggccccatgatctccaatccttggtgttacatcctgtataatattctttccttgagtgtgggtgggacctgtgacttgcttctagttgagattatctacattacataaggctccatcttggagtaagagatttctctgctggccctgaagtagcagctatgttgtgaacagccaatggagaaagccatatggcagagacctgcaacagaaggtggacctgaaggtggcctctggtcaccagcaacagccccaaggaaatgaattctgccagaaatctgaatgagcctggaagccagttctttcccaggtgaacctccagatgaaaacagcctggctgacacgttgactgcagacttatgagactaagtagagaacccaggtaaacttagacctctgactcatggaaact

SEQ ID NO: 9670 - DNA, 1796 bp, artificial
  synthetic oligonucleotide
aactcatttgtttttatctttctaaatcttatattccttcttgagatgcttactggaagtgttaataacaattgctacatctatggctcagccctctctgataaaaataccatgtctaactcccattccccgtcttctaaaagagttttccactacttatggattactccaatagtgctctttgaatgctgcatcaaagaagataacttagacttttatggtatttagtgttttattgttttcctaaaaagtgaatgcagttcaatcattaatcttttgtaaaggagagggaattgtgaactcttctctcaacaattagtgcattcatagagtgatttcaggctctaggatgccacactcctcaaatgtgctagaagtgacactttcacggaggtttgctaagccagttggctggtgtaaacccacctacaaaattggaaatgaagatcctgacaattctcctttcacgtggagttatggacaaatttgaaagcataaagcttaaaatactcacttggctgctgaaatataccagtttcttgataaggcctaacataatgtgcatctgtggtaattggaaaaatgtcataaaattaagtgaaaaagtactttttatatagctttgtcttttccccttaaaaatgtgtgtacttttatcaactcatctatacagtcaattggaagattgtcattcattctacttgctaatgaccacaaaatcctgaagaacatcctacacacacctcaaaatttctggatatgcaaattataagtaattttaatgctcaagacagtgaaacaaatcagtagattgtctactaccacaattattcctacatcataggtaatatgcttctcagatggataaattcaaaatactaatttccctaaggtaaatatggatgtttgggtgatttcaattggagaaagatcatgactcagtcttgaattttactatgtaccattttcacttggatattcactatcatcctaaattccacttatccacgtctgaactgggtgtttttcttctgagtgaggctgccttcccaatttttctgtttttatgaatattatcactattctccgagttgcccagaagcaaactttgagttctctgagatttctgtcttctttatctcttaaatctctttgttatcatacactgtcaattcttactttccagtagatatagggataggaatcttcacactgctctcacatcattccaagccttattcagttattctattagcttacaaatagatactaaacatctaccatgtgccaggcactgggatagacactaaagatacaatggtgggcaacaaaagatgaggactctgtccatgtggtctagcgaggaagacagacattaaaaatcacatgcaaacaaaggtaaatctccaattatgacgcattaaatgaagaagaggtatgaggcgtcataagagtctaaaatagattggtgtgagctagtcatggaagtcagggaaggtaggtttccctgaagaggtgatgcatgagctgagaactgaagaattggcagaagttaatcagatgaggaaggatgggaagtacattctaagtagaggttacagcaaatgcaatggtcttgtagtgggaaagagcatgccaagtattagagaactaaaaagaggaagactaaaaaaaaacagaggggacttagcacaaattgagactgaagagctagagagggaccaaatcatgcatagctttatatgctttattaagaaaaaattttctttttatcctatgagcaatagaaagcaact

SEQ ID NO: 9671 - DNA, 1430 bp, artificial
  synthetic oligonucleotide
tttccagaaggttttaaattatggatttgattttgttaatagttattgaaagattcagattatctttattatattgggtaagttttagtattttgtgccttttcaggaattgaactatttcttctaaattctcagatttatatgtgtatattgtctgcagtagccccttattattttccttatggctgcaggatctgtagtatatcttgttccattcctgatattggtgttttgtcatctctttctctttgtcagtcttcctagaggtttaccagtctcgaagaaccagcttccccagaactacttccttctgactttcatgcttccaggtgacaaatacactgtcatttgaattgttgttcctctgtaagtaatgtctcatttctctctgtctgctttcaagattttgttccttgcctttagttttcaggggtttcattatgatgtgtcttttcacatatttctgtaggtctattctattaggatttgcttagctccttgaatctgtaagactatgtctttctataaatttgggaatttttcagacattatttcttcaaatatgttttcagtcccatactgtttcttctctccttctggaattccaatgatacaagtgttagatcttttgttattatcccacaggtccctgattcacttttcctccagttttctctctgttgtttggattgggtaatttctattgatttatctttgatttcactgaatctttcctctattatctccaatctgttgtcgagtttgtccagtgagttatttattttttcattaatttatttcagttctataatttccatttggctcttctcagaatggcttctatttccttattgaattttttcctcttttttatttgtttcaagagaattcataattgcttgttcatgcatttttatgatttgtgttttaaaaagattgtcagataactccaacatctgggtcatctcagtgtcagcatttgttgattgttctcattcaagtgtgattgtcttgacttttggtgtaatgagtgattttctattgtatcctggacatttggggtattgtgtcaggagaatctggttcctatttaatcctccttattagcaggcagccatcctatttaggtgtagtgctagtgcatcggtccctgggaaggtggatattcggctccccattgggccctgctgacatcaccccagcgaaagtgattgataactcacacttcctcattgcagatgggtggggtggaagtccagctccttccccaccttgattctgtggcaaaagcagatcactgtctcattctgccttattctacttgttgacactgggtgaaggtggagactaatttcctcactgggtcccactgacccaaggttgggcagcaaatcagaatgcagaccagacccactacacccctaccttgt

SEQ ID NO: 9672 - DNA, 1557 bp, artificial
  synthetic oligonucleotide
tcagcagtgcaatggagactggaaaatgcagagaggatgcctattgagctcccctaccctcaccctccacagccccatccccattcccaatttggcatcctctttgctttctccggatctgcttggtgtcggtgacagccgaggggagtgggaaaggagctggggagaaaggcaaaagaggcaggggtgcagggtggtggagagagtcagaaaggcagggcgagagagactgagaggcagagagacaaaaaggaaatgagagacagcgaaagaatgagatacatacagagagacagagagaatgtgagcaacagagagggagaaagaaagaaaaaagaagaaatgggagcgtgagagtgagagagaatgagagagcaagacagactgggagagacgcagacagaaaaagcaaaaaataataagaaaagagaacaagcagaggaagagggaaaggatgaggaaaaaacgagagaatggagaggaagggggaaaagaacgcacgagaaaaagtgagagagaaaacgcgagggcgggaggatggctagggaaaggcgagaaggggccgcaccgcgggccaccgcgcctggtagctcagcagccgtcgggacgcttcagagggggcgtcgtgggctcccaggctcggggccctgccgggtgctgggggccacggagcccggagtagggccgggctgcttacctgttgctgctgcagacgtggcgtcgcgggcgccgcgtgcaggtccttcggggctcctcgcgctcgtcccggccgcctctcggggctcgggcggctgcgagctggcacggggcagcgggcgctgcgggcgcggcaggagcggggcacagcgtctgtgcccgcacgtccggccagcgcgccgcgctgcaagctctgagaggcagcgggggcgcgcggcgtcttaaggcagcgcggtgccctcaccttgcggtgccgccctcccctcggcccccgcctgcgcccgtgacgcacgaggccgccgcagcccagggagcggggctggcaggtggggggccgtgcaccagaccccactcagattttctcactccgggttcccacccctggggccccgagtccaccgagagctcacagactggggattgtcaccggggctgattttcgtgcaaaccccgtgccttcctagccccctgatttcgggccagctcccaggcacagaccctgcactatccttccgattcttccaaataggagggcccgggactcccctcgacttctgaaaaccctccaaagtatgaatagcccctgagcccgagaaaggaatcgtgactttaatgtcaacgattttccacgaatttctctagctcccaggaagagctaagcggcagtgctttccctgtgggatttggaagcatttcatttaagacaagccacataattacccactatattctttgattgaagtatgtctgtctgtaagtcagtcagcatctctccctctctccctctttctccccctctctctgccaggtactgtgttaaactgtttacacagagaataccgctgaatctttaccccagcc

SEQ ID NO: 9673 - DNA, 1357 bp, artificial
  synthetic oligonucleotide
ttgcgttttgctgagttgtcgtcagatattatgtggtcggatgttcccgagaagtgcaagcccctccccgtgggccgcccaggggtggcccgcgggcggtgcgggcgactagcggaggttggagtgggcttgtagactcgctcttactcccaccctctgggaggcccctaaccccgccctttccctgctcgcggcgaaggcaaactgcgcgcacggcgccctctagtgcccaggagctgtcactgcgcgggtgcccgcggccccagctctccccgccccaccaagggtgtttgtgaagatccctcggcacggccgcataccccaatcttcattcctgggtgtcctgaccatcccccacagacccataagacgcagatccgagaccgcttcttgtttgtttatttatttatttagctaaaagtttactaaaaccggggggctctgtcggttcttgactttgcggcacctgcccccgaaggcgccgtctcctccagagaacagcgcctgcgataggattcagcaggggtcacccacacccctaactcaactcgaggtgcgagtccccatctcgcagcgccctcgcgactgtcatctgctgccttcgctaccatttttgtttggagaagcactgagaggagaaaggggcagtctactcctcactaaacgtaacccggtggccccaggcgcagccccatctcctcggatgccaggaagatgcccgcgtgccgctcgcgcgcaggcgctgtcgttttagaaaacccggtgtttggtcagacttagacatcgatttctaccaccctcgcagcttctgtctattgcttggcaaactggtagagtaaactggatttaacaaagggaaaataaatttgccagggcctgctgtgccgaaatgtgggttgctatcagcacgggcgcttaatgaggactgaattatcattaatacgtggatgaaatttatagtgctcattaatacttctgaaagacaacattccaggcgttgtctacctcttccctctgcaaatgtggatgggattcaaaacgtgtgtctggctcgcgagcgcactttgaaaggcaatttaattatcattcatttctgaatttggccatggggcttgtaacactggccttcatttccccccttctctgtgttcttaatgacaccaaggtttctctctgttgccacctaatgaattttactattgaatagcagaggctgcgagaacatgtattcatcccttccaatgttaaaatgttttaaagtacaaagtaagaagaattattattgcttgaattatggcattatcttctcttatttgatttttttttccttctcccctctccttttatgtaaactcgg

SEQ ID NO: 9674 - DNA, 6779 bp, artificial
  synthetic oligonucleotide
acacacacacaaatacgcacacgcacagccaatctatatggcctagtgccttccctcaggctgtctttttctactctctttttgcctggatccacgtgttgggggaggggaccagagacaaagttccgcagtgctttcctccccctgcaactcaagcgaggaggtcgggacttctcctcccctccccctcccaggaatggccctaagcatatctcctccagctaaatcctccttcctcacccaagtctgattgatgctaactaatgtcgagttagttcctttaaagaagttatcttgctaccaagtgtgagccagtccataccggaggtggaggacggggggcgggggcccgggggcggggggcggggagagggggacgaggacggaaggtgaggaaatggagctgggagtggcacctcacaccaaacaaaaacgacgatcgttacattgtatttaatttctaattaatcctcaagagaaatatagccgttttccttaccaatggatccctgttcttactgtgggtatctcgcgcgcgcgaacggtccccaccttcccggagcctcgcagctctaaggagagcaaggagtccccagataactatttagtataaacaaaccgtgtggctttaatggaattacctcagcctgctagtaaataatttatagtaggcagtaaataaaatatggttttacgtctttaaaagagttgtcaagtggaaaacacccaccagagggacataaaccccgaagactgccacgcttaaagacgccggttgggatgacagccgggtggaaagacatgattttctaccccgaaggaagacgcgggtgctgccagagccagagcgggcagctctcaaagaaggttcccgcatggagaaggagcagagacagcctgtctttgtcacttagcagaggggcaacggattaaaacgcaaagggaggaggtgcactctcataatggtaccttctacttaaaagcctagacgctctcaaattcgttatcacacttaatcctcgccaccagtcttccagaaagaccaggccggagccgtgtttcccattttgccgatgaataaaaataaggctcagaggctaagggacagtggctgtgtatgcttgctgggcactaaatgggacgcgggaatctaggtttttgcagctctggcccgcgcagttcttcacccagtgcccccaggagtagctcgcctctgacacacacacacacacacacacacacacacacacacacacacgcagtccagcccagcacacttgcccagttttacaacactccggcatgtcttcttttttcggtgacctgagaaccctctaattaaattttctgcccccctcttccacgaatcacgcccctggaaggctcatccccaattcagagaggaagaaagatttatgagcctctcctcaaggtttcccccaagacaaccttgaccatgaaactagaatcttgaacacttgacctaaatttccaagggcatctgtttccgtctgtaattgtcaccaggcttcatttgaaattcgatcctgtgtcactaatggtattaacaggagctgaggtccaaccttccaacgggagactgttgcatatgattttacatccaaacgaaagtaaatcagtttctataaacctgcagcaaccccctccctgagtacaataaaactgttgtcgcaatcaataaatctctggtttggggcaatgaaaattagataactgttctctctctctttctgtctcttctccccacccccccacccccattaagacaaagccactattcaaagaacggggcgtcttgttaaccatttctgaagtccctcgctgtacccggcgcctttcagacacgcacctctcagtcataggagaaaaccagacgtttaattacggtgacttttgttcgatcattacggataataaagacaaccttttcgctagataacaattataacgcaagctgctccaacacctgcacggatcgcatttgtctccagcgtgtttttttttgtttgttttttgttttttttttttttacttctctaaactgcctttgaatttccccttctcttctgaccagaaaatttaatatgttgcaagagatagatttcacgaaaacgcgttgtcccttctgtagctacatctgctccgacctattaagaaaagtaagacattttgatactaattgcaaataaattgtgatgtgttcaccgagtaattgatttaatgaagttcatatgaaactcctgagattggccaagtgaaaggccccctggtgcttctattgtggagggaaaggaaggttggtttttcgttttctttctttaaaaaaaaaaaaatagaggtggcttggagggaggaaggggatgggggagggggtgggcacagatgttacctccacagaggcagctccgtggcgggaacgagcagccagatagtccctccctcccgtcggcgtcggccgctagccgccagcccggctaaacgaggcgcaggctgccgctcccagcctcgggccccggcagtcggttgagcgcaattcaggggcaaacgtgggccaaggagagggtcagtgcgcgggccgcccgcgtcctccgagttgccaaagttgcacagggcgctgcctccggatcctgttccctcgcttcctgaagtgctcgacgatggcctctaaacctctttatccggctagaggcccagaggctaggaggggcccccaggcggctctcccctgagtcccggcgcccaggtcccagttgaggccaggggagagggctgcggtagctagcactacgccactccgcgtgcgggccagggtctccaaggttcgggtcccgagctcaccccacaagcaagaatatacggacaataaagccgccttcggcctcacgggggttttccttttcaacctttctggccagccacgtcggcgagttaaagggccgggcgtgcatgaagggtacagagagggaataagacttttctgaacacctactgtgtgccagacccagtgcttcacaacagttccctttctccaagcaacggtgggaggtattattgctccctcttaacagatgtggaaactgagatcggacccttgacagcaacgtgccaacaatgccctggctaccctgggccatcaacaagcacggctcgtcggaaaggagaaggcagattcccgcaaaactgtccccagtttgccccaaagccctccaaatattccccccggagcatagggatacaaggcagaaactgccgccgggccccgcccatatctcctagttggcggagcacagtctcctgctcgagtttgaaatttttgtttcgttttgttttaaagaaagaagacctcttttgaataatcagagccctagctgagctagcgagtggctccaagctcctcggagttgccctgcagatgaactttccctgagttcttcctcccgggtcgcgggtccccctaatctgggtcccaaagtgcccgcaggagacagcggtgcaagggtggtcatgctgactcgggtgtcgggcgccgccagaacccacaagccagagtgcgtgggagacgggggccggagggatgccccctccaccctctcagcccacttctgggaggccgcacccgctctgcgccttgaagagaccgcccgcagcgcgaaggcgggtcctcacccgaggatgtggcgaaacgcttaacacccaggcaaatgcaaatggtcaacgctggggtctgaccgaggccaaattatctccccaagaggcaaaagcaggcgcgaatgaaggcgaagagaccagcccctcgctttccgtttcgacatttgcaactgtacagcgctccacccccagcccggggggaggggggctgggaagccagcagggcctgcctgggccgggccgccagaatgccaccttgttctgggtggaaactggacactaagtgcccagcctgcttcttccagggagctccgacaccacgctctatcagaacgtgtccggcgctggcccacccttgccgctgctcatggcccgccgtattcgttgttcggcccgaagaacttccccttttgctttgatgcgggcttttcctatgtttttcgggacccagaacgaggaagggctaggccatctcgccctagcacgggggaacccagctagatgtccttgaccccagggttagcgtttctgggacccaagagaggtctcatggatgtctgggccccttccctcacctctgggtcctggagtaggtgaactggaagcaactctctcccgctccatgtgacaagtacactttcttgggtcgcaagtccgagccctcccctcctgttcatcacaaacggcggccgcaagggcccggggcgtcgaggaaggggtgggctacagcgccgcgggctagggaggccacggggcatgggccacaaggatcttcgggattgttgagggaggcgcccgttgggagagaaaagttagaatctgagcttggccagccgggattgtttcgggatgaccttttcttcccaataagtgggcaccagctgctgataaaggcgggagagggacactcagcctttgtgaacactttccacattcctggggccaggagattgacaggggccttagagggtatggagctcgcggcatcccgcttagtttgaagttgcagccttcgcaccccaagacttcccccttccccagggatcagctgcaaccccaatccaggcggcccgctccccctgccgcagcgccccctacggtctggaggtgggccctgaaaggttccgacgggcgcggggagcccaggggtgggggccggggaggccgagggaagctggtgtgctccggtccccgtctgagaagcggtcacccgctggggcttggcttctgaaagtgcgatttaggtagctgggagtggagatttacgatcctggaggacagagcgtgaaagggttatcatcatcagttttgactgaaagaaagaaaacatatctttaacaaaaagaagggctcttgccattcacccgcgttgttaggacaacgtgaactatccttgaaatgattagttccacttcaaaggaatttacattcaacagtgaaaactcagcctctttttatttattcgaaaagacttttcactacggagaaaagtctttcctgctatttatttttccgcgttcacggtgcacttgtattaaatcaacagagaccgcgcaacgcactcagtatgcggaccagtccagggttccggggacgcaggggtacaggtagagcgggggagggggttgttggggttggggtttgcaccacgcaggcacctgcctggcccaggggatggggtgggaagcagtggatcaggtctggggccgtggggggaatgcaaccgaagaaacctcacccaagcccagcccaagtgcagtaatcagagattttgaatgctcgcgattctcatagagcctggcactctctacgtcatttgtggagaaagtggacctgaagttccccagcgacaccttaggaacatctgttaaaaactgatcaggttggcgtaacttcgctgggcaaaattaaagcctatctccacaaattgagaagacaaatcccacctcttagtagcttgggacgtttgctcacacacactctctcagggcccacacctccgcgccccaccccccaccctcaggtcgccaattgtcgccaaatccaggaaacctctacccaaaggaacaacagcactaagtttacgagcggcgcgtcctcccggggcgggggagggggcgggggagggggtggggagttggggaatgctacccctctaactgtccccggagtgccttgagctgtggctggaatacttcccacctcctccggaaacgagcagcagcaaccaactctcagcttcacctcacacacccacccgcccaaccccattcccacctcccgcagcaaaatcttttcttcaacccagggctaagtttttctcaccaaggacaatgatgttaagctttcccttgatggtcttttccagcttctaattaaataggaaaaaaaaatctgggttggacattggattcaagtttttctaccattccttaacatatctggatttgtacctggcaactggccccatatcttgaaatattgtcaacatgaatcgtaacagttgtcctttctaacacagtttttggacggctcctcagtaggttcagaagcagtgaccacaggctgcttggctgggagttaaaggtggccgctgtttgccacctggtaacaaaggtgtaagttggagcagtgactggggcaagcccttattctcctgtgtttcaggttgaataagaactcaggttttgttcaccattctggagctactctcatgttccttcttcctcctggatcttcctgggcttatttcaccttcttggtctgaaggtttcctttgtttcttctcttgctcaaacctaatcctgaggcatcccctgctccctctctatctctatcccctgctccctccctatcatctcctgttccctctctatctccctccctatctctctaaatctctctgggacatttcctgtccttcatgaggaatcaaactacagttacacttgagtcagaatcccaagcaggaatgtggatttgccaactctcccaggtggttgaagagaatgtgcagagaatcatgagattccaacccccatccagccccattcccaactagatctatgccttaattctaacactgagctcctagagactttcaaatgggt

SEQ ID NO: 9675 - DNA, 552 bp, artificial
  synthetic oligonucleotide
tttacaaagaaactgtacacatggcatgcctttgtgtctcatcatgcagcctcatcttatctgtagacacctctttccaattccgtttgcatttttgaggacagtttgaaatttttccacacacatccaggtgtaccccatccaaaaagtctttcaggactccttgaacctattgttattcttttcagaattcccatagtatattagatctcatctttgctatatgcaacttggtgcctaaacataatctattgtcccaataataatagttcttatatcatgagtgcaagataaacactgagctacattttgaagatccaatcagaaggacacagttcttatcctttcttaggaactcacaggctaatgagaaagagaaccaaggagctgtgatctgttgtgatttgtggtgcagagaggggcacacaagtagatacttgaaacagtagatacttgaaattactaattgattcatttccagatacataaccaagccaataacaacacaaagcccaatctatagtttttcttttgcttcctgtatctactttt

SEQ ID NO: 9676 - DNA, 5621 bp, artificial
  synthetic oligonucleotide
agcacaccggggacaagctgggtaaggaagcgacttcgatctggctggaagcagatgttaatggtgtacaactagttgaacatggaagtctagaaaaattacaagcacaaaaggcagagggccagttggtgcactgggcaaagagaactgagagagtgagcggattgactttttgaggccagatttgaagatatagatggggcagggggacgtgctggagcccttgagaatcggaaggcctcctgtgcatagcactaagtgtttgcaccaagcttgctcctggatcctcgatcctggatcctcgaccccaaggagggaagaggacacgtttctcccacccacctcttggcttgggatgggatgggcagtgccgaggcaagagaaagcgacccgagaaataggtgcgtggtaggaggcggcggctgggactgctgcgcaactgcagggtagttgggagcactacagcgccagaggagcgtcccgcccggcagggacttagcaggttgctggaatcctaacctcccgcctctttctggcatgcagagcagaaggggcccaactgaagaaatgatcacgcggctcaggaaagaagctacttgtgtctggtggtctcgactgtcacggtttcacaaccggagagcaagcttagctcaacactggaaacagcctgagggctgtgccctctcgcccttggacccctggagctggctgggtccaccctggagtcagcttctgctttttggcaagaccttggatagccttatttttaaacattttaacgcccccactttttgaagaagcagtccaagagtaaagtgaccctttagtacccccaaagaggggatgtggttggcccctttaagtgaaagcctagggaaggccacgtagaccttccggggggagcctctgggtccccaccccactcctgaaaagaggccctggcctttgggatcgctgggctttacggactagaggtggggtaggtggggaggctgcactgccaggaccccagcaacttccaactgctgctggggacaacttactgcatgggcaaggctctggggacagaggaggtggtaggagagaaagtccgtttagaggaacagatgggctcaaaagaagttttcagacaaacctgtggaatgggggtaaagaggacaagcaggactccatgcatttcccaataaaagtagggtgagtccaagtctacggcaggagaccagttactgtgaagaatgtacagaacgtacagaatgtgcagaaccaacttgtaggagcctaggtgagactggaagccagctccagattccgatttgaatgatgtgtgacgctgtctcttccctcaggtagacagcatacaccttccgagctccctggcctcggccataattgccagccgctcctctgggttgggcctaagagcagccggctcccggaccgcggtggcgcaggcgggctctgcggcgagccggggagagcgcggctgccggagaaatatgctaatggcggcctctccggcacagtcctggatttggtctaggctttctggcttggccctggaactctcagcaaggacgggtcgagtacccaagccgtggagaaagcccaggaagggcacgtgctaggatctcacacctgacccgcggcagaggctgctcgggggtcagacctggcgctggcgtttctttctgctcttccgcctgtgttcgggtagccacaggcttcccagaggcctggagctggtcgcccatatgcgcgtgagtgctcatctcccagtcacaactgttggcaaaccgactactacagccgtcgagttcacacttgaactggtttacgcctggaaatagaaacttcaacgctctcaccccatcctacggagccgctaagcaatatataagaagggtaataacgtattcgctggagacaacaaataattccccacgttaaaataactgattgttttcagaaatttattttttacataaatatataaaacgaattcacgccgatccccattgcacccagcatttgagaaattaccgagtgatctgtagctcagagacagacaccggcgtggtccgagtgttacagcaaagtctcagcacctgtaaacttgcaacactgagacaaatgaaacccctcgcgccggcatccgctggcgcacaagctcctgcggcccccgtcgcttgctctggaactcctagctctgggaccacttccctacccgcagatttcgccaaaggctattgcaaaaacccaccctttgtctcataaaactacaaagagccacacagccagaggcaggcttttcggcaggctcctcagccttccccggagataccggcgagtctcgggtgcaccaggcaggagcaagttttctccttactgggattggggtgcgcctctcttccacccggtggtcctgtgcgcaggggtgtgctgaggagactgtaaaaaagctactaaccggcagggcctgctctccacggaacaaggccacagggagaagaagaggggagcccctgggaacagaagaacacctggcagggctggggtggggattgcagctagtccatgacccaactacggtgtgaacctggacccggaagctgggctgtaagcggagctaaggtttcttctcctccctatagggctagcctaaagatgtagtcattacggaagccaccttttgggaatgaatcgggatgggcagcaatttccgaggggtgtggggtggggaagagagagcgagagcgagcctgagggtaggcgggggctagcaaaaattcggagagctgagcactcccctcgccttcggctcccataaggacccacccctgtcaacaaatggtaagtcctttggggaatgctagagaaagaaactggcaggtcagagataaaggtgcgcctgggcgctggggatggagtgggagggcagggaagggttagtggtccttgtcccgtggaaatcgtacatgtgctcggaaggcttgtgtaattggaggccaaggggtgcttgtattagtgtgcatgagaaagagacagagagacacatgagaccaagaagctgaatggacgtgtaagtcgcactggacgacaatttcaaaatgcagagtttggcttattatgcaaacgaataaatctcacacagctttcacttgttcatcccctgcagaccgtagcggtttgcactctcctggttcaagttcgaagtggaacgggaaacaaaagcaggcaacgattccagcgcggcctgaaagacggaccacaaagcctcctccctcgtctctcctccgggagccgggaagccaatgtgacgatcaaaagcttccacatcgccccggcggggcgcgccctcagccctgtcggggaggtggggaatctgcagaaatctaggtctggaggctcctgccaatttttccttgaatcagaggaaggcgcgggttatagggccctttctcccgtgggttcaccgccgggagaaccaagtttgtatttggccattcagtgccacccgcgcctgccctaaggctccgaggtccattaggccagtaatcgtcccaactggggaaatgaatggttggcctggcctgggggcaccggttccttcctgcctgtgggcgtctctagctgagcctctggttcagggctctgagctctgccaaggcccatgtcatttagtggcccctccggggtggggacggcctctctcggaagggtggggaagtccctcgaaactatgggcagggagagagaagagagaagagacccactgcttgttcaaaaccaagccctaacctaagccaggtctaggcaagacagagacacctcttacataggagtcaccggccctaactcctccccgccatagctctggagaggaggtgcatcttaaagatgatcctcggctcctggtggttgaggtgcagcgtcaggttgcacctggtcttgcctttcccggcgggcgggccaagagggcggctattgagcctcgcggatccaggccctagaggccaggaagaggagatcgcgcggccttgataagccggatcaccagcagtgaccctcgttgacgtcggggtaaccccgctaagtgaccgccacgtgagaaagtctgggccgctcacaatgcgccggcgcctcgttagggccgggcgggcgctcggggagccaggccagcagtgtccgcggcctcatcattcattcccctggacgtgctggtaaaaatgcatcaaaataggctgcggagcgcggtataaaagcacagcgggatgagctgctttccaaaaaggatctcggtgattggaccgagctcggcgtgattgacaagagcttagtttggtaaagggaagacacgcaagctttcacagcaggagcccttttctaaaatatatcacactagcctttgaaaagcgccgcacactataaggaaatagcgtttcacggcttgctttatggtgcgatgacatttctttaaaacacagcgaagatcaaaaaaaggagagagagaaataaaatgtgttgcaaacacaatgttttaattagtttattctgcgcgttgcttttaactgtcgtatacattgcgggttttcctttaattaaacagtccctctcgagcggtggcaggcgaggaaggcgaggcgctgcgccctttcgtttccttttggaaaaacgagaaggttggctggccccagagcccagctcgcaggctcctgtgccctcgcggccaggataggcagactgaggcgttggggcttcggaaagcggcgggacccgagcgccccacggaggcggagaaggaggggacgaggaggaaaggaaggggaggaggttctcccccggggaaccgaatgggaccaaggcagtgcgagtagctcgggcatggcgccaacctccaatcccctccccacgagctccagccagcagccggtgtccccccgcccccctaacccgcaccacctttccaagccctctctggtcgccagggtggtggggagcgataggcaccaggatgagccctgcggttctggccgtctcctcggctttcgggctccgatttccagctacttagccctctttggatcccaaagtagcggattctctgattcctgacccacaggaagaagagactacgcaagcatccgctcgccgaaagcgcgggcgccgcaggcgctgtcaaaagtggcgcctcaagaaagacgagagttgagctaatgggggaatgtgttgtggacctaagcctgttcttacacacacacaccccacactctcactcgtacttactacacgattacttcatggaaacctctgcagatttcggttctaccaacaaccaccctctctgctccacacaccccaaagacccggcctcagccttaacccagcgcttgagcctggcatagagtcagctcatgcagtactctctcaacaatatttactgctcaggccggtaggtagtgatggtaggcagtctgtggccttaaaatcagagggcattgttttgttaattctgctggtgagatctgaagacaatacaaacctgcagtctggtgagaaggtggagtggaggtgtagataagagatgcagatgtgacctcctaaatgaaccacagaacacaacc

SEQ ID NO: 9677 - DNA, 9464 bp, artificial
  synthetic oligonucleotide
acttcagcctatgtctctgaagttcaagtatatatatctgtctgcacagccctgattgacaagtacaatgaaaatgtctcattcctgtctggtttgcatttcattacattgggtaacaatatgccttgtatttcagaggacaaaggcaaaaaaaaaagggggggggttaattaacaatatctgtttattctcgattgaattttaaaggtatttagggcttataaaatatgtgtcaaatgataggaccatagtgaaaattctgatgtggccaataaaatctggagctgtgtgattttacgctcaccaacctgcagacacacttggttggcaagtgtgtcagcatgtcctggagatcgatagttcagcttggcccctgatgccaattaagtgctttatcttagcataaaaataaagagaagttaaaaatgcattcttttcccagctttcttcccccttcattttttattgccacttgcagtttttcttttaaaaagatctgggactctgaagagagggtggggatttatgtaaagaaagtgtcatttaccaggaaaaaaggcgaataatggtgagtttcaaggacatgttgcaatgagaaacactttgtgctccactagggagagacaggggcaccaaattcagcgtcctggaataattcccttcctggattcaaagattcatttattgaaataaatcaggaagccttggcagaacggaaatccgcttgctgggtttaaagggcctttaaaatgttgcgagtgttagattgcaagtcttttctaaatacaaaacagaagaaaagaccgcagcgtttcccttgaacttaaagaaaattactaggtcaccgaatcaggataatttcatgtccaccacataaaatgtgtttagaaagaaatgctgcatgataacacaatgtgctgtgtatgttctgtttttcggaggttcgacggaagagaaaagtgctgtggagttgggctctgggttgtaggaagaacccggtcctaccctactgcccctcaggacgttctgtttccctactgcttcttcaagatggattctaaaaatcgggctcaaaagctttgctggtttagaagtgatcagtttttctgattttatttactgctttagatttgggcataaaaataaatctttttcctatttaccgtttgaactcagtgtgagggaaaggatcccattatatttcctatccatacaaacatgtggatatttagacccgaccacatacaacttggggacacataaaagagatttattggttaatttacgttgcctactacacatgtaaaccctagtaagccaaagctgctgagggagcctcagctatagaaccacgacccctgggttcgagttgtcctccctgactagagctgtgactcctgtctccacctgaaaaacgaaaacacgagagttgtctccatcccctcacctctgcctgtgtgtaggaaaaacttttctcctcttagctttccctcttctgccaccactctgttctcagactcagctccccaaagcgccctgttccccgaagttgttcccagagtctcctcttgaaaatcaagtttggggaggagagaagctctaagtcataagaaaaacttcgcgatttttcccccccaacagcagtgatttgctttgttgggggtggggactttgttttcatgtgcagtaactagctttatctggagggattttgctttctaccctcttttaagggtcaggggtccccctccccaaataaggaaactcccactcaaaccaactgaaaccgacttagaaatggcctgcctctgacctgctgttcacaaagcccccagcctcgtccttttgcgcgcatctgggacccctgcgtcccacagaacaacgacaccccctcagaaccgcactctcaggatgggcccggctgtcccgtgaagggctccattgcccgggattttggcctggctgaatcgcctcaggtctgcccccttaacaagcatccacccccccggcccccacctccccacttctcggttgatgatctaattgaattatgcctttttgttccagggactacagagcacgtgctggaggcaattaattatcggaatgtggccgtatcaaaacggacactgggcaccgggtaggtcagcggcggcaacttccccctgccttgagctcaagaccccttcccaaataggggcatgatgagctccctcggctgccccccttctgagcccttcacccagttgcaatcgcgcaaggccctcgattctcggggtacctggcgggactccccggaaactctcgcatcagcgctggcccggccagagctcgacagccgccccttcccggtcccctagtctcgagaaccgctgtccgcgggaccagctcagtgaggaaatccaaactttttcaaaccaactacttagccaagggcggttggggttggtgggaggtgaagagaggtagagggaagagaggaaataaaggagaaagtgaaaagaaaggtggggcgggggggggggggggaagaaaggcaatcctccttttttgtaaacctgactccaggggattcatttgcatgatttaagcatatttgttctctgaacacaccagcgcccccctacccccccaaagaaaccctctgctgagaggcactgaaaccattcttggagagcctatgttcggcagacgcaataatttaagtcagcagtgaactcaccttccaacctggggagagagctctggatgtggagagagaattggggcgagtttgatgggagggggtgaatacggtaagatgtgctaccggtagggtgttctcccagcaaactggctaagaaagaaggtgaagtgttggctgggccaggcagactggggagcaggaagtgaaaggctgcagttataaagcgctgcttaaggcggtctctcctggcgcctctgaacttgatcagatgttctatttcctacagagagatggcggccaggctgtgaggctgcctcaaggcgcagactttggggcttggcccagctagggatgtgacaatcacagccatctttctctctgccttttctttccactctcttctgcattctttgcaaatgccttgcaggacacaaaaatgagtgaatttatagccttgtctgaacctggtcattatgtcagaaagaccttgcaacagacagaaggcgagaggactttcacacacacccctggaagtaaatccttaaggggtaagcagtccctgaggtcactacatgctttaccttctccgggtaggagtagaagagagtaaagccttggctgttcagaggaaagaaaattccatgtcacagtccccattcagcatcagcaacccccaacacgacttttgcatttgaaaatgttgagaattcaaagctgattagcctagtgatttggaaaccaccctgatactgtgtgtgtctagtgtgtttattatgtgtttagtgtgttgtgtgcatgttttgcgtacactggctaaaagtgttctttgcatgttttgtatttgtgggtatgctcgctgttatgtgtatttgctctgttgtgtttagttgtgtttctgtgtttgctgtgttgtgcgtagtttatgttactgtgttgtatgtgcttactttgttgtgttgtgtgcgtatttcatatgtcgtgtttgtttcctgtggtgcgcttgtgtttactgtgttgtgtgcttgtttcctactgtgtgcttgggtttactgcgttgtatatgtttgctgtgtcgtgcccggtgtgtaattcgggaagtgggcagcggcgagtacggccgctgctcacaaactaaagggtcaacgcttggcgcagacggaagtaacggagatcagctctaattgtaatcgtttcttctcctttgggtctcggacagctgccgacaggttgggggcacaaacggcgaactatcccggcctgggtcccggcctcgaggccatcagaactcgcagtgattggaggtggacgcagcggctggaccgggagcgcgaaactgctgcgctctccccaggatctgcgccctgcagctacagaggggacatgttctcaaggtggtgaggcagcgggggcccaagcaggactggacgttgagcgccgcgtctcctccatcggcgcagcagtgggaccgatcctcgcggggcaaagagcccgcgaggggtgggggaaagcccgcgagagtcccggcggcgtcccgccgtttgccggctggagcctggccccagttccccgcagccactcaagcccggtggagcccactcgcggccgcccggcagccgccgcctcacctgccaggcacccggcggctgcccaatcagcgggggtcgctcggccgcggctgccatgttctccgctccgcgctgccaatcagcctcgcggcggccaatgggcagtccggccggaggtcaggtgaccgcgggccagctggctccccattggcgcgcgcctcgcggcctcccgctcggtttatgtgcgaggagtgagtgattgactttatcagtccaaggacattactctggaggcgaagaggctgggactcgcgcggcgagcggcaagcggcgagtaacgagcctgcctactgcccgctgcccgcctgcccggccgctagccggctccgccacttggcgcagcccagcccggaggccggtacccagggagcctcctggccccgcggttctgtgcactcggggagaggaggggtgcccgggacaggattggcaaactccgccctccacttactattttgcttatttttctttgtgcgcgcctgttagtttgttaaaccagatctagtccgagtcttttctcctcccttctcctccctcctcctccccccgccaacaccccctccctgctctttcttcccctcctccctcctatccctctgcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtaagggaaaaaagcaggcgggcgtgggttccactggcgataccccgtcacgcagcggacttagagcgcgagggagagaggtggcggccagggaaaggggcgacgccccgcaacggccgctcgaaaaagaagcgctgtcagtgaccatccacccctagccctccccgtcccgtggcgcctttgccgagttctaacttcccgggcagactgctctgcggtctcaggaactaattgggaccttctcgcgcccaggaacaaactggcgccgcctctttttgtctccctttctgggttaccgtgaagggactccgaatgtgttgagagcatattgcttacaagcgacttagctctcggcacacattcgtggaaggcaaccatacaaatgctaatgaaaactaactttcggttacttccgcttttttttacacttgattggcacatctcctaattaaatgactgatacttttgtcaaactatttttatttggagttccaggttcaattcagtcctccgggaggaaagctaaagcagtttcgtggtttgttcagaacatcttgtaaaactgtctggagccccctggatcgatcgatctatctatctatctatctatctatctatctatctatctatctatatttttttcctcaaacattaactacgactacccaggctttttaatatcgggcttagccaaaccgctgcatttgaaagaggcaaataaaaaggtacaaagaggctgaacgggattgtcctgtccggggcccattgtcccgccgggctcggttacattgctgaggtggtggcggaacgtggccgcgcattgggagccctgggtcgggtagggtggaaacacaacttaggggaaacttcggaggagccaggggctttccctccttgcaagaacaaagacatggtcaggttttgggccggccccgccccacccccacccccaccccgaccaccactcccaaacccagcgggctcaacctacgctcttcatttctctccagggaaaatagatgcagcagcagcccccagtccgcgctccctttccgggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggtaattacctctttattagcggtcggcggtttgtaaacactcggcccgacgccgggccgcggaacggaagcgcccgcgctgccaaccctctgtcttccacgttaaatccgatttgctccagcagtgacaccttgaacccattttggggaccgggcgggggtgggggtgagggggtgggcgggagtgagcaaagttgggagggggaggaagcggagggaacaatcggttgtttactgggaagctctagccgagctcgcctgggcttgcggggctgccgtggccgcctcttcccgactcagcccgcggtgggaaccgagagtagccgcgccgaacccgagggtgggtggttcattcgctctttggcttcggataaaacaatagggccgaggagtgcaatctgattcccacacatttgtctgcgacttcgcagcgctcagggcccctgtgccaccttctctgtacctgctttctcaagccgaaacgggcttggtgaaacctgggcccggagttagtattttataggacctcacagtgtactgcttacctcactccatccgcggagaaagcatttttgaagtggcatgaccaaaacggaatgctttattccttttccgtaacaccagtcttaggagcaaaactggtttttggcgaacatctccgggttttctagacatcggtaatacggattttttttaagcagcatttttcttttaagtgggtcactgggcggtcttgttgttacagtgctcgaattctgctcttgtttttgcttgcacattgccagttggaattatattcattataatatatacatgttaattttaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacaccccattcttaaactcctccaattcattttaacacttgtcctgtttcttgagaggaagttatagaaggcttgttggtggtggtgatgttaaactgatggaaattctttttcgccttagtggtgattgtttaaactctcacagtcttaaaccgtgccaaagtcctgttatgtcttgaacttttcctcaaagcattacacttgtgaatgtatttttgtctaatagggtcgaaactgttgttcagtattttttcaggctgaggatgtgatgttactctacacattgtgacgtttagtatacagttgccttttgtaataactttttttttgtaaatacatatccattgatgccatatttatcgtttgtaatttaattattgctacaagtgccgggaactgaacaatatttatggataaatgttttctaacaaattctgtacagcttttgattataactgctttagcattaaaaattgttttgaaagaagaacacaatttacaattttggaaccactgactcctttctcttgttttgtaacagccttcttctacaaagaggagatgtgagcaaattaaatcttgtttgttggtatttataactcactcagatcccttttttaattgttaaattatttttctattacagtataaattccttacagtgtcagtttccatctgggaagactctcctttctttatctctatctcagatggttgtttaactgcgagtttaaat

SEQ ID NO: 9678 - DNA, 2746 bp, artificial
  synthetic oligonucleotide
acaatgaacttccataatttaccactttctccatgagttccctcccccaccctcaatctaacctaactttacgtggaagtagagccatgggttggatacaggattcaaccaaaaacctgcctccctttcaattaaatgtattaaatatctcctgagacaaagagcagtttgatcttttcttagttacctgaaattattctaccataaaattttacaggaaagtacttgagggtcctaagaggggaagatatcaattaaatgaaaaacaattatgataaccaatattaggagaatataaaagttttgcccctgtacatgattacctctaatttgggtgtagcatggtatttctcaaaatcacgtcctccacccttgtcatctgtggtaaagaaaactccttattttgatagaaagcttttcacagatttcccccctataatctggctctgggagtgcacatttacactcttgaatattcagtaaacaaccttagagagtaagtaccccccccaaaaaaaaaaaaaaaaaaaaaaaccaaacaaaccaaaatcatcaatgctcaagcccgaggcatgggccaggctcttaggaatcaacttgttactttccctcttgcaccttgtaagatctttgttcaaagtccctttttcaaaatgagtgattttgcataagattcccactgttaggcaaaagggaggtggctatttccacgcaagacagaagtttggccttcatccagctttagaaggttaaagatcaggacagggtccacgctaagcaggccggtcgatctaaattactaaagttggacatgagtgagcaaagacctccgctcacaaagcatcccaggaaagttggagtgttcaggacttcctcgctcctcccccttctcccttctccccgcctgatgtctctgcctcttcgccctggctctctctcccccttcttaaaaaactccctaaaacagaggagcaaagtcgaagggcctcttaacatgtaagtttgtggaagaatcgccagcagcgtgcccatcgcctgaaaagagaggttatcttggcacctagactgctttcctctcacaggtttctgtccctcgagtcccaagcctccagtggatccttggccggggccggggcggaggcggcgaggccaggcgtttcggaagtcggggctccagctcagctgtcctcgggcccctcgtcggggctcccagggtccctgtccacacaccaagttcttgcaagtctctgtcgaggctcgggcggggggggaagggacctcatttcctagggtcaattctctcgcggtctctgcccgctgaccctttgacctccacctacagggcccttggcggccgtaagccggcggtcgcccgggctccgaggacgcttcgcgccccatcgcctcccagcctcattaggccggcggggctgtaaagcaggaatcagcctctgcctaatccggacctggggtcaatacgagcccaaacaatggtgagctccgaaggccactgcgtagcgctggccgcaaactttgtgttcaattcaattttctaaagcggtgggggttgggggcagggaggcattcgtccacccgaaagccgcttgcggctcccggggctcatcagcgaacgtcctctctcgctcggcccctccagccttttcgcagcgcctgggatagagggggcggcgaggcctggggactggttgtcggcccgcgcgggtgcccaggggctggcgcaaaaggggccgcccccgtgccgggaacagactttgaagtgggtttttagcgcgcacgtgtgagagccgggccagggccggagcggggacccgctgggaggaaagaggaggctccggccggggccccaacccctcccccgcttccccgtggctccggccttttcaagccgcggccgggggcccgtaggcctcccacacccacccccactcccgcgccctgcccgcgccgcgcgcaggcgcacacttcgcagccgtcgagtcggattttgcagcgagggggttggggatagagttgaaagccgctttgcagtgccgcggcctcggtcgagctgggagggaggggaggggaggtatgtgggaaggggggctggttttggggcggctctcgagtcgtgaacatggcggccggatgcgaacccccgcggagcgcagcaaagcgcagcaaaggctgcagaactgttgcgtagtttaaactcccttgttattcctcagttctgggcgcctcgcgggggaatgtaggtcgtggcggttgagcgcaaaattgttaaaaaaacggaagcgaagaagttcttcctgggcattctcctgggaagttggcgtgtgctttttgggtttggggttcccatgggacttggacaaaaaacccgccagaggcctccccacccacctggcccgacctaaaacgccccctccgggagctgccatggctaggggatgccatttcgagttatcaggccccggtcgggattccacagaaccttgagtccctaaaaatgccccaagagcggacagtatgttctcttccaggacagtggcgaagcctatgaacacgtaagcaccattttccaagaaaatgccccggctgttagacaaatgtgccattgcgagttcgacccctacacgttgcccaggctccgttttctgtatatctcatttaaacgtgagcctatgaaaattggcactgtagctttggtgtgtgccttaacagctggtgatcttatgttaag

SEQ ID NO: 9679 - DNA, 3727 bp, artificial
  synthetic oligonucleotide
gacatatatagaaatgagtagttttttaagagaattgctatattataaagggcaatttaactctatagaaggatccaccccccactcaggtaaaacagtctctaatcctattatgtaaatgagtggaaaaaagacatatcacttagcagaatttcatgtattggcagattttgttctagctataaataaatgtacttcttttattaataggttaagctttatcgagatcagaaaacaatatgatgtgtccgaattgctccaatgtgtaatgactgaccactttaagttatggccattgaaagcaacttgaaacaacttaaaagatttatcaatgctatattttatttgcatgcatttcacatgcattttgagaggaaaaagcaaacccatttaggccaaagaaatcagcttgtgattttggttaatttttaaagagtcaagaaaaaatagatcattttgaagtaaagcttatcttgtgacaacatttagttccattagcttttactgaatgatgagtagtaggagttctcaatatattttgaaaggattctctctcttttttactctggaacatcaccagtcacccctctccgcctccctcctctgttcagttttatgtaaacttttgaatatagtctctgtttctcccagatgcttcatatttacttccagcaatgccagggactgaagatctcaagagtgacccttctttgttttctctctgattcacttttaaggcgcatgaaaagcactaggctgacagctctggaggctcaagacctgttgatctctgcaccatgtgcagcatggaccttctctgtcccattagcagtagttctccctttgcacctgcaggaaccagcatggggcaaaggccaggctgctccatccttggtgcttttcctgaaaggaagcaattaaccaggattcaggggtaggccctttctgtttcttctaacacttctcgcctacttctcctttaccccaaacacacacacacacacacacacacactcacacatacatgcatacacacatactcattcattcacaaactctctaattggcttatatgaactggtgcctggtattgtactacagagacccatttatttagaaagaatttagtaaatacttgccatgtataaagccttgtaccaaactccaatggcaaaatctgtgttctcaccacagtgaataattgaggctgttatccagacgtttgagatgtaacttttgtattaacttgaattatctctatccatggttctctattgagggtaggtgggtggtagaggtgggaggcagggaatccatataagtgctctacaaattcatatgcaaattgactaaacagtatatctcattttcatatgtaaatgtattatgaattcatagtagcttcttttatttgttttttaaaatggtagtaagacatataatttgtcattttaaccattttaaggtgtacaattcagtggcattaattgcatttgcaatactgttctgccgttttcaaaacttttttttatcattccaatagaaactctgtacccattaaacagctctccacttttccctccgttcagcttctggtaatcttttgtctacttaccatctttgtgaatttgcctattttagatacttcatgtaagtggaatacaatatttgtatttttgtgtctggcttatttcatttaagataatgttttcaaggatcatccatgttgcagcatgtatcagaatttcattcctttttatgactaaataatattccattgtatggaaaggccacatttgtctatccatttatctgttgaaggacatttggattgtttccaccttttggctattgtgaataatgctgctatgaacattggcacataattatttttttgagtccctgttttcattttttctttttctttcttttttttttttttttttttgagacaaggtctcactcagtcagccaggctggagagtccagtagcatgaacacagctcactgcagcctcaacctcctgggctcaagcaatcctcccacctcagcctcctgaatagctgggaccacagatgcacaccaccatgtctggctaatttttgtattttttgtagaaacgggctctcattaatattgaccaagctggtctcgaacccctgggctcaagtgatccttctgctttggcctcccaaagtgctggaattataggcatgagccatcactcccagcctgagtctctgttttcaattctttgggggtatatacctaggagtggaattgctaggtcatttggtaattgcatatttaaatttcagtaatcaccaaactgccttccacagtggctgtaccattttacattcacaccaacaatgtatgaaggttccaatttctctacatactcctcaagactttttattttttcttttcttttctttttttttgtaagccatcttagtaggtgggaggtgcatagtagctctttgttgcatactttcttactattctctgtgtgtaggagagcaggaggtggttccataaaatatcctcgcattcaaaatgtattctcaaattccaaagtttgataacctctaatttagatacatttttaaaaatctctccacattggccgggtgcagtggctcatgcctgtaatcccagcattttgggaggccaagttgggtggagcacctgaggtcaggagttcgagaccagcctggccaacatggtgaaaccctgtgtctattaaaaatacaaaatcagctgggcatgctggtgcatgcctataaccccagctacttaggaggctgaggcaggagaatccgttacaacccgggcggcagaggttgcagtgagctgagaacacgccattgcactccagcctggacgatagagcaagactctgtcacaaaaacaaacaaacaaacaaaaacaacaacaacaacaaaaaacaactctctacattgcacgtttagaaacattttatatatccctcatagtaatattgtgaagtattattatccttatatgaggaaactgagactctgagaagttaaataacttacagaaatagatgcccatattcagtttgtccagttcccaattctcagagaactttcctcaacattctcctaactacctttctggacatggactgttcagaaagcaagacataggccttggaggaaagcaagacataggcctttttgtttgtttgttttaaaccttcatgcatctgttctccctgccatggccctacctgtctaccacggttttattctttactctctgtctatgtcaaattctcttctattttgattgagcctttcctatggtggaaacattagggaatatgagaaattgaaaaacagagacggaagtaattctgaatcgtaatgccatgacatagctgcataccatgtacatttacatacatctacacccacaaacacacgaattcacatgtatacatataaaggtgtgtatacgtgtatgtgagagagagaagtgtgaaagtctttatctttttatttggtactctcgctgctgggagtaggcttaagtggcaagtaatacagaccatttccttgaaaaatcttgcagtttgcttcttctctccttagtgctccacagagagcataataatgatggtctcattgggaggagggctccaaaggaggttgctcactcttaggccacactctcagggctgctccatgtggtaggg

SEQ ID NO: 9680 - DNA, 1598 bp, artificial
  synthetic oligonucleotide
tttgataatggatataaatcagttatatttaaaatggtaccaaagtaaagtaaaacaggtgggtttctttaaaattaaaaggtcatatgcattttaaaaatacaatgatgtgcagataatgaacatgttagcatatatagccattaaaatgtaaatcaccttgctaatctccctcacaattgaaaaaataaatagactatcaaaatatttaggggaatatcagatgaaattttacttaaattttttcttccagactttttattcttcacccaagattactttggtctatctaaccataagaagaaaaataagcttaatacatagataaatgcttgtcttcctaacactacaaaagaaacatttgttctcccagataactcttaagtaaactgctgtcaaaacaattagtgttatttttctattatcttcctatttgagagtaaataaccatttcatgaatatgttaattatctggtaggtggaaaagataagaagggctctatatctccagaagcaatgataaatcatcaattgtatacaaaaacacaagaaagggttataagcgggatagtcatatgtctacatttcacctagccaaagtaaaatcagttcagttttgatagttgaaagagaaccaggaaaaaagtgacaatattttgatagaatgaaccacgaataagccttcatttgtgcactgtggctgcaatgagactgtcttctatctcaccaagtattcaatagttttattgctaagaaagctatttgattttcacaaaatttagaacacacgttttgggattgtgttaattgtcactgtaaagaattggagaagtgaagataaacccttgagtatgttcctctcacttagaaaagcctagtttatgttacaagtactgaacagagatttttctcttataaaatcactttttaaaatatatgatcgtgcttactttaagcttcatctacctttagtaatcatgcccaacttttggcagctttgaatgtgccttttgaaatctccggcacagaattcttcaccatccgcagtggttaaatgttttgctgaaagggaacacattttgaagggggagaggaggtgggggtggggagaaaacgcagaaaagtgctttctcttcctattttgaaggggcaagatgtatttttccatattaaatattttgaaaaagttgaatgcagcattgtgccagataattaaaatgtaaatttcagtatctatgcttgctttgtgatttttttaatacatttaagttagttgtcttttaaaacatgtggtcagctgttgtattcacatatggtcaaatgatcaaagtctgaactcctctctaattgtccccccgctgctcgtctgctctgtccgtgatcaaggcctcagcaggtgatgagaaaggcatgagaacaagctggaaggagaatgaggcaccgagaggcccaagctgaaagaaataaagacttccagtacatcaccctgacagtaaagagcaaaggaaaagtgacgtctggttagtagtgcttatatatttttttgttcgccaatctgcatacattttttccctagctaaatgcaaatggagccgagc

SEQ ID NO: 9681 - DNA, 1444 bp, artificial
  synthetic oligonucleotide
tggcagcatctttctaaaaagcccaaagctcaagaggtgtgctaccttgcccagaaggctgaaccacctcctagtatttcaagagccaatgattaaattcctcagtcagttgcctgttaagcactttgaatcatttacggtcacatttgtgtgtgtgtgtgtgtgtgtgtgtgtgtgtgtgtgtgtgtacttactgtgtgccaggcatcatgccatgtgctttacatgtattagttcaattgattttcataaaatcctattaggtgggtgctacttttgtttttaattttataggtaggaatgctgaaatttggagaaggaaagtgctcaaggtcacacatctcttaagttgcaaagctaggattcaaacccacacaccaaagccaagttctccaccactttgctatactgtcttccaggccatttgatcttataaactaaaaattagacacatatccaaaaacctcagtctggcttggagtgtcaagtcagactgtcatctgctagcgagaccttgggcaagttacttcaagtctctaagcttcaatgaacttacctgcaaaaatagtgataatagcattgcctctctcataagggatattgaggtgaaatgaatttatgtatgttaagcatttagaacaacaccaggcacatagtaagtactgaatacatgatgctattactattacataaatttgagtgtgccatggcaaatattgtgtcctctgaaatagtacccagacaatgacagtccatcagactctcattatcccattatgcagacattacttttgctctcaatattagcataatgaatttagaaattctgctctagtcataggtggtctgctatgaaactagaggaattttgtttttcttttaaattatttaattgacaagtattatggagaaactcctacctgtctcagcactgtactaagagtgagagtattacatacgaagtaagggatagttgccctgccttcatgaaggcaacagtccagccagagagactagcatggaggaaataacaatgaggaatgctggacaacacataattaagtgccaagtggtatgatatttatttgaagggacatgaaagttcaataggcagggaagaggtgaattggaatcaatattcacattagagccaattgatgagaatattcactcctaaaacatgcagcagaattgactgcttgagtgctaaccaaagctagagtcggcctggcctggtagtcattgagacagatgtcatctagctagtcccccatgtttcttagcaacccctcattccctctcatgactgttttctagccagccgctctcactatgtatccccttactctgtgttctgtttctttatagtacttatcactacctgacttaatcatatatttactagttttgtgtcttgtctatttctaccattggattgtcagat

SEQ ID NO: 9682 - DNA, 989 bp, artificial
  synthetic oligonucleotide
tactcttcataatctcatgccttcacttggaagctagaagttagataaccatctacatcttattaaagtcattgcattttattaggtcagctcccagttaacacagtccagaaatttcattcatttgcatgatttgggagttttcacttacatatttatctcaaccgacatctctgaatttgtttatatatttcttaagagagaaaattttattggaatagcaataggcattcccagtgtttttagacctatgccctcaagactgccataagattcaagaggggacttcccaacttttagttacttgaatccctctcatcccaggatagtaggactgaattgtctgtgacaatgtttttatatttacagtttaaaacctcacatactacacaacaaaaatacaccttattatctatgatggcatgatgtataaagaaattcaaggccctttcctaccaacagtaccactaagaagcaagaaactaaacattcacatggtatactgagttgatttatcagtgaatttactttagggtttaagtgtattgcattagatatctcttaaggaatatattatcaatgcagtttcttttcacattgtattagttgtctcttaaaatccaagcatttatgtttaagacatcctcaaggaagaacatggtttaattacaaggagaaaagccaacagaaacgcttttggcacagaaaatttgcactctgccagagtataatttatccctgcgtgtacatacataagagtatagagtgaaaaaaaagggggcatattttcctgtcagaccacatcgttcactgcattcccagcaaaatgaagggaagatgggttaaataacacgtaaagcctaggatttccacattcagcagcaaaaataagataagcattaattaattaatccaactaaactttgagtacctcttcaatgccataatctggggttggatttccgaggaagccagttctgagatgggct

SEQ ID NO: 9683 - DNA, 1884 bp, artificial
  synthetic oligonucleotide
acatgcacacagtcaaaagcttaccgaggtgtacaagtatccctcactgttcattgccaagtacagcttggtttgaactccttggatagccaccactcgcagacccacagggatgaggttaaacagagctgaaattaaaaaagaaaatgaaaacagtgttacaattctgaatttcagaacttttcaatgtttccagcaggactgcctggtcctccaaaagtagtgtgtagttggtgagggtatgcatatatgtctgtttatgtagacatgcatacacatacagacccccacaaacacacccacacataccccgaggcagacagataggtctcattctaccttttagtgtatttaatttcatggttgcagccaggtaactggagctgtaactacatattatttaacagcctggagaaaatggaaggcttttggtcacaatttcatggtttttacagtgttggaggtggggaatcttgatgcttctggaaagatacagtcccaagaattgttctgtacattaaatagtgtcattctcaacaaattaaggttttaaactgctccccaagataactgctgaaattctcacagtcatatttaaaatctacctgttgggtagagagtcctagacttttagaagagtccaatgccctcatctaaattatctgtgttattccaaatacaagaactccaaaataaattcaggtcttgtaaaaagaaaaagtcattttgtagtcctatgtttccagagtagtatttccttttttcattttttgagacagagtttcgctcttgtttcccaggctggagtgcaatggcccgatctcggctcaccacaacctccacctcctgggttcaagtgattctcctgtcttagcctccctagtggctgggattacaagcatgtgccaccacgcccggctaattttgtatttttagtagagacggggtttctccatgttggtcaggctggtctcgaactcctgacctcaggtgatctgcctgcctcggcctcccaaagtgctgggattacaggcgtgagccaccatgcccggcttcagagtagtatttcttaaaggaccaacattttccaagattagagttgagagggctcctagcttttagtctccaagaacaaaggacataggaataaaaataatgaacttgaaagaggtttattttattattttattattattattttagcaaaatagttgcaagtgggcagccagttggtgccagtgaggacttcatttctccatttgaagatctgactgcgtgaaacttacacccaggctttcctcacaaccacacaccactcactggagacaactagtgggtgtcctcccactaccagctgtctactccctcccacactgtgaataaaaataaaacagtacatttttaaaacgtagtgcttgccacacacatcttttgaaaatagcctgtgcacctttctctcaggagtcgtagaccaatgttgatgattttgccttgttttgtaagtttattgaggataataaatcagtctgttatggtttctgtgaacaagaatgtaaaggagtcaccctgtgggtaagaatagtttttctgggatcgtttatctctgtgcatatacattctgctgcagtaggtggggtaatatggatgagaaatactaatgaagacctaaatattccttggtgagcctacaacgtatcgttcctttaaaaccagggtgttaccaaagaggagctaggacatattgtacggttcaaaagacaagtgttcctaccacatgccactgatggcacttcattcaatactcatcaaattaaaagctgtgcccttctgttatgtgaggtaaaggaatgtaattgcacagattgcaagccaagatctcatgct

SEQ ID NO: 9684 - DNA, 1800 bp, artificial
  synthetic oligonucleotide
caccacagtctgggtatgagcttaaatcccctcttcaacaccgcattttagtagcatgtaaccgattacactaagtctaaccaaatctctcagctctttgcaacaaggttctagaaatcccccctccccccgccccagcaaacatttcgaagctgcaccacaagtcaagtctgtcccaaaaagcttaaaagtcatcaaagaaacgcaatgcctagacagcagaagcccacatcccttggaggtggaagctggaggggaagggtctgaggcagagataaaagcaagagagggattccccaggctctcctggggacgggaggatggtgtctgcccagctctgcgcctgcaatttccacgccatacatatcacagccatgtctgggtcacgcctgcccagagcccaccgggcatgcacatatgtgacatgtccgaagctgagggcaagccacccagggcagagtatgcccccaggctctgcgcctgtcccagggcagttgcaatgcagcaagcgtgttactgttacggaggcaagaaagccagcgccttcccacgcacgcacacaggctaggtggcctcttctgcacaagatgggccaccaacaaactcacctatgctacatacctgctccccaccgcccccacctcactcgtaaagtatggggaaaagaaagcaaaagccctttccgacctggtcttcttctgcgcctcttcttggagccgaagagtttgacccgggaaaagacatttaacttgtttttgtcgcagctggtcttgcctttgctggggctgctgacacacttgcaggcgttggatttctcgcgctcgcgggcttgcctcttctgacggatgagcgagctggcgatagccgccgccatggccacgacgcccaccaccaccgcttcttttgctgcccctctctgggttcgcctcctcctccttctcctccgctgcttgtccgctgtctcgcgacttcgccgctttggtctccttagcctgcgtttgcccgggcttctccgcactcgggcttcagccaaggagggggctcagcatgccgtccgagctcctccggcggcggtccggctcccgcgcgggctgctggctgcctgggtcggagtcgacgccacagccccgggcccgggatcgcgggcgagactggcacgcggatgctgaactgcgcgactgcgtgtggtcggcccctgcgcccggcggacaccgtgcatgtccagctgctccggtccgaatttcgccggaccccctcgccctgttgcccttctgatgggggccagaggagggaggcgggcggagggagtgagcgcgggcgggagagaggccgggagctcgggcggccggacggaggagggacgaggcagcgcgcgggggagcgcgccctcgccctggcccctccgagtcttcgactagtccttgcaacttcttggcgtgataatcgggaaaagttggcccgtgccaggtttccgacagggatcaaacaggtaatggcctcgcatcttcgctgttgctgctgctctgggcgcggcacagtcgcagcacaggaattcagccgccgcaggcaccctccggaacagcgcgacagcctccttgcagccccctcccgcgacggcccctccctcccggggctgagcccgtaggctcggagccgcaggccgcccctcccacccccacccccacccccacccccccaagtccccggccgcccgttccggctaacacctgtaggggcttccgcactgccccagtcgtccaaatccttctcccctccttttcccgaaaggagcttcgggag

SEQ ID NO: 9685 - DNA, 777 bp, artificial
  synthetic oligonucleotide
tctctaatgttcagaagcactttttacccattccttttaatccccgagccaaaccttacctgattttcagtcttcagaatttgtattactggattctgcaaatctccttgaaacatgtagcatcctacctttcaaattcttaagtagaaatcaaaaagaatatactacttcatctctctcctggctcatgagtgatgatcaataataatttcatgttgtctttaccatgaggacttgattagggagagaatgttttcttttaaaaaccaaattttgcattagttgacactttgttcctgcaattagctacaaaatgcaatacaattgctaacactcttcccatgaaacagctgcttgataaattctaataatcttcagagaatacagagaatagtaatgatcgtcatcactatggatgcttccagaagtgtggttttttttttttttttttttttgcattaatggcaaggaaagcatagaagaaatttgtgtttaggagaaatacaggttgttttctggatgataagaatgaatagggtttgcttgtagatgcccattcattttggtgacttcttaatgtatgtattcagtttacagacaaaaaaatgaaagtgaacaaaaaagtcaaatagaacagagaagataaataggaggaaggtttccattcacatattaggaaacatacattgaaatcctaatatgtacaaggccttgggttaagcactaggagtagaaaaatacaaataagatgcagtccctgccctctacaagctcatg

SEQ ID NO: 9686 - DNA, 938 bp, artificial
  synthetic oligonucleotide
attaaagcatatcaatattaactctattttataggattccagtatttctgccaagacagttctgttgcagtgccacagaaaatgtccccaatgaaactgtttcagtttatgaatgctatctatttctagaaaaaacacacgctgctgcttctcataaacggggaaagtttacataagagaaacaaaacataacacccaaaatgaacagtacatttaaaataaaatgcttctgtactgccggaaaatgagcacaacgaatacctaatatattttccctattctaaattccttatacatgaagcattttttattccttagtttttgcctaatagattaaaacttaatcattaaattgctggatgaacaacctcctcccccagcctgggctgtttctatgtggaaaaataaaacatgtgggtagtgatgtggcagaaacattgcaaagttttattccatgaccatttagtagtagaaatggtcataaattctaagaccaataaaaaccagggccatatttatttgataccaaaaagaaaatcaatcactttcctattttacaaagacagaaaaagcataatctttaaagtcaaacaaacatgggattgagtcctggctcccacacttactatgtacatgatcctgggcaagtctctcaatctttctgagtccttatttcctcatccgtaaaatgggggttatgatacacttacttcacagggctgctgtgagatgaaataaaatagtatttgtaaaactcttagcacagtgcccaacatatagtaggctctccataatcattaaccatcaagttaccctgctttttttgtaataacaacattgagataccattcatatactatacaattgactcatttaaaatatgcaattcaatgatttttcatattaaataaaaaatcacagctgggaaaccatcacca

SEQ ID NO: 9687 - DNA, 3205 bp, artificial
  synthetic oligonucleotide
ggccggctgtcagcagacagcgcggttcccggcgctccaggctgcagcagcttcgtctgcccgcagcgccaccaccgtgcgtccagaggggaagtggaggaggctggaggcactcgagggtcgacaattccgcgaggaaggagggaaagtggtgcaaacctagatccaccccctagcgacctctgcccccccttttctcccggggtcgcagaggtcatgggcagcttaggctccgggaaggaggcaaggagccgccggagggcggcgcgcacgcgagggggcgagggaaacgaaggaaaggaaagcaggcggactcggcgggcgggcttacccttagaagcatctttctcctctttgggcttggtcacctttccactcatagatcccagcttgcttgacaaggttcgctcagaagacggaagtcctcgccgagcgggtcggacttgggagagtgcttagggcggcaagtctcgaccacgagctcccctcggtgtggttcggggcggaatccgcttttccccaccgctgccgccgccgccgctgcctacgagagagtggggaggaaaggaaaggggtgaaggaggagccgccgtcgccgccgccgccgccgcgatcccgagcggccggccgcgggaggagccgctcgccgcgctcaagaagtgaagagacaaagcggcgcggcgcttcctccgcgccccgcgccctcagcttctgcccgcctgcggagagccacgctcgcaacccccggggcggccgagaggagcggccgggactccccggcttcactgccggcctccctgggctccgcgcgggccgctcgctgggagttgcctgggtgggctgcccgcgcactggcaggctgctttcccccgcctctcccaatccgctgcgggccgccaactcgatcaaaataaaaccccgaggaaggctttttaaaaaatcaaaacaaagataaaaatattcacttaaaaataacaagcctccctgaaagggaaatgtttgaacatgtgatgagcaacgtgtgagcctgttacaccgcagagtcgcgcagcttctcgcccgcggggaatggggaggagagggtcgcctcttttctttctttctatttaatccatttccaggttcctattattttgccaaaaagggggccggagttgctcgccggcggaggagtgggagacgatggcccttacctgctctctttctctctctccctacacccacaccccctcggagctcgcccgctccctcgctcgcgctctccttccaaagaactctccggtcctagagagccacgaatcaacaccgcggcgcattctatataaacggcaaggtgtgggcacgcggagggtgggggctggcgaaggcggggcctcacaaagccgcctgcccgctgtagtaaaaggagagctcggcaggggcgcgccgacgtcagccgccggttggcaaaaccccggcgagccccgcgtagtgcgggcgagcgtgtctgctgggcgtaccctggcccctccggggcagggagggcccgcgggtgccactgtagcgggctcccaccgttggccaaggagatggaaggccggcgctccccccaccccggcccctgtaactcctctactcctagcgcctgctttcccaggcccgtgctggtcgccacctacactttggggactcccctgttggcaactgctcgcaccgagcagtggaatctcagtccgggagtcgacgacttttcgcttctggctagctgctcaagttgagacagtccggctctcagtggggagagaagggctctctgggatctgggtgtcagtaggtcagagagtgaaactgaccgcggcggctgccacctcccacccccacccccacacgcaggcccctcctcctagggctggtcgctcttgttggtaaactggaagcaaagagtgcccaccgcccaggatggccaatcccaggcaaacgggtgaggtgggactgggggcgagtgctgaagaggaataagtaggattgaaacgttgcctgaggaatacttgtgacaaaacccagagaaggtccctgaagattagaactagaaggaaaactgctcaagaattgttctacagagggcagatgaggaaggaaagagagagagagagagagagagaaagagagagagagaaagagagaaagaaagaaagaaaggaagagagagagagaaagaaagaaagaaagaaagaaagaaagaaagaaagaaagaaagaaagaaaagagagaaggagggagggagggaaagaagagagaaagaaagaaagaaaaagaaagaaagaaagaaagaaagaaagagaaataaagaaaaagaaagagaaagaaggaaaagaaaaagggagagaaaaggaaggaagggagggagggaagggaagggaagggaagggaagggaagaaaatgaacgaactagggaaggagggtgagatagtagtcaggaaatagcccctggggcgtcctggaaaaccttttctgcgatggccttttttttgtgcatgcgagtccctggtagcctcgcgctctgttgagggactggggtggtgactagcaggacttggtcctcagaacagtccattaatcagaccttaggcttcatcctggccatgaaggcgcggtagcgactcccatgcagaaaattcgttttccctcgtcctactcagctccacccccttcttaattcggttttgttaatggcattaaaccaggcgaagaaatcatatagatggattagtcttactgcatcccaggcggtaactcaattacaagagcctgctgtggctttcaagaccaggagtgtgggctgcccctgctcccagtccaggtctaaaggtcggcaaccctctaaactcaatttgcagcctccatcctcagtctgagaggaactccaggcccatttttcttgtaaataatatctaataatctgaggcttgatgacacgatgtgattatccaagccaatgttagaccattagttcatatcagttgtctgggaaggaaaacatttctcttcaaatgatcgaattcaaaagggttggaggtttagatgggtttagaggaaaggtcgaggggaaggggagtcctaccccaaatctcagcattatgcagtatacccatgtgatgaacctgcacatgcacttcctgaatctaaaataaaagtcaacattttttaaataataacaatttatac

SEQ ID NO: 9688 - DNA, 883 bp, artificial
  synthetic oligonucleotide
ataagtaaacagagaaacttaagttaatgtaacaatgagatgacttatttttatccataagacttacaaaatttaaaaagagcagtaagataaactgttggtggggttgcaagggggaaatttgtactctcataaattactagtagacttgtaaatatgttatatgctttttaaaaagcaataagtcaacatttgatgaaattaaaaacaatatgcatatacccttcaacccagctatttcattcctgggaacctgtttcagactgaaaaaaccaacagcatgtaagggtatatatatatataaatgtgtttattgctatgttgctttttagtggtaaaatatgaattggaaataaagtgaatgtccactaaaagtggaatggttgaataaattattctccatctatatcacaaaatgctgtgcagccattaaaaagaatgaaatagtgagattgctgttgacttgtaggttttattgaatgggagtaatagtaacgatgataatagcaaacattcatatatggtactcttttaagtgctttacatattttaactagttgactgctcacaacaactctatgatataggttctattataatcctcattttctcgatgaggaaactgaagctcagagaatctaaggccacataactagtaaaagacaagaagagtaagatacaaaaatgtgtgagtaacatgacataatttctgtaaaataatctatagtaaaagacaggcatgggcatatgtgtatatatatatatatatatatatatacacatgttttatataattatatgagactggcaatatggaaatataatactcagctggtagtatggattattacatatatattatatgtaaagtatattaaaaata

SEQ ID NO: 9689 - DNA, 8788 bp, artificial
  synthetic oligonucleotide
gaaaggttagcatttccacgtaaacaccaagaggacagaaagcttggatgttaaggggaaaaaaataaagtacaaaattgttccagcctagttttccaatttattcaaattctgatgaaaaaaatacatactcctaatgagaaaatagtagagctaaattttaactatgactcctgtaaagcacaaactgaaagttgccaactgtccatagaaaggcaagatctacaattatagggaagggagaagtaatgaacaaatagattctggactagaccttctgtatactttctcttttaatcttaatggcaaatgtgtatagatgaagaatcaaacttatagagaataacagatttgctcaaggtgacatggctggtgactctgagaaagcaaaaagataacagttcaatctccatgttatttcacagagggctactgattaaaaagaacaggaagaatgaggatgaagagcaggatggtgatatagaaggctccaccgattgttcccccagcaaggacaccaagttaacaactatctacacagaaaaaacacattcataagaacaaaaaatcacgtgagtactcatagtacctggttttaacttcatatcactgaaacaggcactgaagagatagaaaaaaaagagtccagaattgatgacattacccctcccccacctgctgcagcagctgcatggtgccaacagcatctctgggcactgagggagagagagcgtagcaatcgtgatggattgaactcggtgctgttctgttagaacacaaaggaaaaccagaccaaactcagctaatgtccgcccacagagggagcatttaaaccagccctagccagaggggaatcacccatcccagtggtccaaatttgagtgcttgttaaccttgccaccaagggctacagcattctgtgcctccaagtaaacttgaaaggcagtctaggccatgaggacagcaaattttaggcaagacctagggctggactaggcctagagacagtggacttggggggcatgtgaaatactgtgacatcagctgggatcagccaagggagtgcttgcatcaccccttccctaacctcaggcagcacagtttgtgtctccaaaagacaccccttccttctgcttgaggagaagagagtgaagagtaaggaggactttgtctggcatctaggataccagtctaaccacatcagatagggcaccagtcagaattgtgaggtccccattccaggctctagctcccagacaacatttctagacatatcctggtcaagaagggaacccactgccttgaaggaaaggatccagtcctggcagcattcttcacctgctaactgaagagcccttgagccctgaataagcagcagtgatactcaagtactacatcgaggaccttggtgagcctctaagacttgctggcttcagatgagactcagcacattaccagctgtgacagctattaggcaaaactccttctgcttgagaaaagcagagagaaaagtaaagtggactgtcttgcaccttaggtactagcacaaccacaggggaatagggcaccaagagggctcttggagtccgtaattccaggacttgattcttggatggcatttctggacctgccctgggacataggggagcccacagccctgaagaatgagtcccaagccaggcagcattcacaacaagcttacttaagagaccttgggccttaagggaacatcaggagtggtctggcagtactcctcatggcctgaggtgggggtgcctatggggtgagaactcctctgcctttggaaaggggagagaagaatgggaaggactaccagactgttatcttgtggtttgagtgccagctcagctgaaatacaatagaacaccaggtatacttctaaggcttttgactgtagcccctgactcttggacagcacttccgaacccagctgaggcctggggaacttctctgctctgaaggaaaggacacaggcctggttggctttaacatctgctgattgtagagctccagggtcatgaggaaacacaggcagtggacagggagtggttatagcaggtcttgggtgagacccagaactctactggcttcagacctgactcagtgcagtcatagtggtggtgaccacaggtacttatgtcactccaccccagccccaggtggctttgaacacaaagaaaaactatgcgtaggagaaactaagggaagagaaaaagtctctgccggctaatccagagaattctggatcttgtccaagaccgcaaaggtggtacctctacaagtctgcaaaaaccatggcattatagggcttggggtgcccccaaaagcagatatagcttagagcacaatacccaggttcttttaaatatttggaaagccttcccaagaaggacagctgcaaataaacccagacagtgaagactacaataaatacctaactcttcagtgcctagacaccaaagaaaatctactagcttcaacaccatccaggaaaacatgtccgcaccagataaactaaataagccaccagggaccaatcctgaagaaacagagatatgcgacctttcagacagataattcaaaatagctgtgtttgttgagaaaactcaaagaaatttaagagacacagagaaggaattcaaaattctatcagataaatttaacaaagaaattgaaatacctaaaaagaatcaaggagaaattctggagatgaaaaatgcaactggcatactcaaaatgcatgagagtccttcaatagcagaagtgatcaagcagaagaaagaattagcaaccttcaagacaggctatttgaaaatacagtcaatggagaaaaaaaagaataaaaaacaatgaagcaagcctacaagatctagaaaatagcctcaaaagggaaaatccagggttactggctttaaagaggaagtagagaatgagatagggagagaaagtttattcaacaggataataagagagatgttcccaaacttagagaaagatatcaatatccaggtacaagaaagttatagagcaccaagcagatttaatcaaaagaagattacatcaaaagatttaataagcaaactctcaaaggtcaagattaaagaagggatcccaaaagcagcaacagaaagtaaacacataacatacaatggagctccagtatatctggcagcagacttttcagtggaaactttataggtcaggagagagtggcatgacataattaaagtgccgaagggaggaaaaaaaacgttttaccccagaatagtatatctggtgaaaatgtccttcaaacataaaggagaaatagtctttcctagacagaggatagctgagggatttcatcaacaccagacctgtcctacaaggaatgattaatgaaatacttcagtcagaaagaaaaggacattaatgagcaataagaaatcacttgaaggttcaaaactcacaggtaatagtaaatacacagaaaaacacagaatattataacaatgtaactgggcatgtaaactattcttatactaagtaaaaagactaaacaataaacaaatcaaaaataataactagaacaacttttcaagacatagtacaacaagatagaaatagaaacaacaaaagcttaagacatggggaaacaaagttaaggtgtagaatttctattagttttttttccttgtttatttatgcaaataatgttaacttgtcatcagtttaaaataataggttacacgatagtatttgcaagcctcatggtaacctcaaaccaaaaaacatacaatggatacacaaaaaaatgaaaagcaagaaaccaaattatatctccagaaaaaaattacattcactatagaaagacaggaaggaaagaatgaaggaagagaagaccataaaatcactagtaaacaaattaaaaaatgacagaagtaagtccttatttatcaataataacaatgaatgtaaattgactaaactctccaatcaaaagacatggactggctgaatgaataacaaaacaagatccaatgatctgttgcctacaaaaaacatatttcacctataaagacacacatagactgaaaataaaggaatggaaaaagatataccatgccaacagggatcaaaaaagagcaggagtctctatacttatatcagacaaaatagatttcaagacacaaactataagaagaaacaaagaaggtcactatataatgataaaggggtcaattcagcaagaggataaaacaattttaaatatatatgcacccaacactggagcacccagatataacaaggaaatattagcactaaagacagagatagaccccaatacaataataagagctagagacttcaacaccccacttccagcattggacaaatcttccagtcagaaaatcaacaaggaaacatcagacttaatctgcactataaactatatggctctaacagatatttacagaacatttcatccaaaagctgcagactacacattctttcctcagcacatggatcattctcaaggatagaccatatgttgagtcacagaaaagtcttaaaacattcaaaaaattaaaataatcaagcatcttcttggaccacaatggaataaaactagaaatcaataagaggaattttggaaactatacaaatacatggaaattaaacaatataaacctgaatgaccagtgggtcaatgaagaaattaggcaggaaaacaaaaactttcttgaaacaaataataatggaaacacaacataccaaaacctctgtgatacagcaaaagcagtaatcagagggaagtttatagctgtaagtgcctacatcaaaaaagagaaaaaatttcacatgagcaatctaatcatgcatcttaaagaattagaaaaacccaaaataagtagaagaaaaaaacaataaagatcagaggagaaaccaacagaattgaaatgaacaaaacaacacaaaagattaatgaaacaaaaagttggttttttgaaaagttaaataaaatagacaaacctttagccagactacctaagaaaaaagagagaagatataaataaaatcagaaatggaaaagggaatattacaactgatactgcagaaattccaaggataattaatggctactatgagcaactatatgacaataaattagaaaatctagaaaaaaaatggacacacttttagatatatacaacctaccaagattgaaccaggaagaataaaaaacctgaacagagcaacaagaagtaacaagattgaagccataattaaaagtctgtcagtaaagcaaagcctcagacccagtgatgtcactgctgaattctacaaaatatttaaagaaataataccaatcatactgaaactattctggaggaaggaatacttccaaaagattctacaaggccagtattaccctgatacctaaaacataccgaaaacacaaagacacaccaaaaaaaagaaaaaagaaaactacaggccaatatctctgtgaatattgaggcaaaagtcttcaaaaaatactagcaaaacaaatttaacaatatattagaaagattattcatcatgatgaaatggggtttatccctgggatgcaaggatcattcaatgtgcacgaatcaatcaatttgatacaccatatccacagaataaaggataaaaccatataatcatttcaattgaggttataaaatcatttgataaaattcaacaacctttatgataaaagccctaaaaaaactggatatagaaggaacataccccaatgtaataaaagccatatatgacagacccacagctagtctcatacagaatgcagaaaaactgaaaggctttcctctaagatctggaactcaacatggatgcccactgtcaccaccgttattcaacatagtactaaaagtcctagctagagcaaggacttttcttgctctgttttatagagaaagaaataaaagtcatccaaagtgtaaagttagaagttaaattatgcttgtttgcaaataatataatcttatatttggaaaaacctaacgagtccataagaaaactattagaactggtaaaaaaaaaaaaattgagtaaaattgcaagatacaaaagccacatataaaaatcagtagcatttttatatgccaacagtgaacaaggtgaaaaagaaataaaaaatttaatcccatttacaatagtcacacataaaagtaaatacctaacaattaacttaaaaaagaagttagagatctttataatgaaaactataaaacattgatgaaagaaattgaaaagaacaccaaaacatggaaagatattccatgttcatattctggaagaatcaatgttgttaaaaatgttcaaactacacaaagcaatctacagattcaatgtaatccctatcaaaatatcaatgacattcttcgtaaaaacacaaaaaacaatcctaaatttatatggaaacatgaaagatcaagaatagccaaagctatcctgagcaaaaaggaaaagactagatgaatcacattacctgacttcaaaccatactacagagctatggtaaccaaagctgcacattacctgacttcaaatcatactacagagctatagtaaacaaagcagcatggtgctggtgtaaatacagacacatagaacaatggaacagaatagagaacccagaaacaaatccaaacatctacagtgaactgatttttgacaaagatgccaagaacatacattggaggaaaagagagtctcttcaataaatggtgctgggaaagctggttatccatatgcaaaggaattaaactagaaccttatctctcaccatatccaaaaatcaactcaaagtggatttatgacttaaatctaagacctcactctatgaaactactgcaagaaaacattagggaaaatctccaggatattgatctgggcaaaagtttcttgagcgataacccataggcacaggcaaccaaagcaaaaatggacaaaaggaattacatcaaactaaaaaatcttctttacagcaaagaaaataattaacaaaatgaagagacaaaccccagaataggataaaatgtttgccaactacccatctgacaagggattaataacaagaatatataaggagctcaaacaaatctataggaaaaaatctgttaacccgattaaaaaatgggcaaatatttgaatagacatttctcaaaagaagacatacaaatggcaagcaggcatgttaaaatgtattcaccatcattggtcatcagattcagcaatcccactgttgggtatatacccaaaacaacagaaatcagtatatggaagagatagctgcactcccatgtttgttgtagcactgtttacaatagcaaagatttggaagcaacctaagtgtccatcaacaaatgaatggataaagaaaatgtggtacttatacataatggagtactattcagccataaaaagaatgagatccagtcatttgcaacaacatgaatggaactggagatcatcatgttaaatgaaataagtcaggcacagaaagacaaacattgaatgttctcacttatttgtgaaataaaaaaaaatcaaaacaattgaactcatggacatagagagtggaaggatggttaccagtgtctgggaagggggttgtgggggaggtgaggatagttaatggatacacacaaaatataaagaatgaataacatctactatttgatagaacaatacagtgactattgtcaataataattgtacattttaaaacaacttacagtgtaattgatttgtttgtaactcaaaggataaatgcgtgaggggatggataccccattctccgtgaggtacttatttcacattgcattcctgtatcagaacattcatgtatcccataaatatattcatctgccatgtacccacacaaattaaaaataaaaataatttaaaaagaaaaaagaacagttttgacccttcttacctgctcaggatatgtttaatgaaatccagtaacatacgtctcttttgcccctcataggcaatcttatattcaccattcttcccccctcaaagaatatgaagttcacaattaggagaagaggcttcatctctacaaattccaattccttatccaataaaatgggaagcacctatttagtagggctgtcatgaggatttaaaataaattctgtaaattgcctggcacatcatagataatcaatacatggcaagccttaccactattaccatgatcaattgaaagtgaaatttgcatgggcaacagtgggattctgattccagattatgaaaatttctggtagcaaaataatgaaggatttaagaatgtgagctctggagtcacactgacctctgtccaaatccatttttttttttttttttttttgagacggagtctccctctgttgcccagactggagtgcagtggcgcgatctcggctcacggcaagctccgcctcctgggttcatgccattctcccgcctcagccttccgagtagctggaactataggcgcccgccaccgcgcccggctaattattattattttttattttttagtagagacggggtttcaccgtgttagccaggatggtctcgatctcctgacctcgtgatccgcccgcctcggcctcccaaagtgctgggattacaggcgtgagccaccgcgcctggctccaaatcctgactttatcacttcctaactgtgtgacccagaaaaagtaatttaacatttcttctcctatagaaaggggataat

SEQ ID NO: 9690 - DNA, 445 bp, artificial
  synthetic oligonucleotide
ccccacccccaggatcatattttaaagttgggcccttgccttttgggtcacataggtacactgtttgctataccacaggtatagctatctggaaaacatggagggtattattctgttactactgcttcgtcaaccaaaaaataaaacaaaacaagaacaaaaaagaaacaaactccctgcctcttttcacttgcagtcaaggttcctaaccactacaaaattagcctatgtttcttcttgcacatagtagaaacccaagcttctcactgctgtgctattctgtaccatcaactcatcacataaagagcctggttgaagaatgattgtccaaccacattactagcatctgtcaagactttccagtttacaaaaggcctatcacatttaaccctcacaccatccttgtgaccaaagcattattaactccattttacaggagagtaaa

SEQ ID NO: 9691 - DNA, 559 bp, artificial
  synthetic oligonucleotide
catatacattagttgaggtagattccccacaggcctactcatggtctattatacttttcacacagttcgaacaagcttgattatcttgttccctagttcgtaacactcagagaaggcaatggaggagggggcatggaggattaggcaataacaactggccagtagaaacagttaaattaacagcagcaaaaaatatcagctaacagagaggaaatctacggaaaagttagagggtaaaagtcaggcattgaaaattaaaaagcagaacaatctgtccccatttagtatagggacaaacagccctccacagtttaggagcccagaggcagcactgaatacagcacattgaaagaactaatgctattataaggacaatcttaacccatcaaaaaaggatgcaattatttccaggttcaggggtcaggaaggtaaatagtatttttgaaaagcttctcatccaaaatggatacatattttaaggggaaaaagtcaggcactaaaagtgttgaacctcagttacccagaaaaatcagttacgtggaacactcacagtatcgtg

SEQ ID NO: 9692 - DNA, 2403 bp, artificial
  synthetic oligonucleotide
gaggtatatttggaacatgtgttgtggctatctgatttgtgggaaattgccaccaagtctattttttgaataccaaaacttccactgcaaggcttagaacctactaagtcaaaactaccttgggtgcacaggaaggcgcgcacatcaattgcagcaccttgcagacttctctgaaaagctctggctgaacttcaggtctcagagttgcactctgttctgaggcagccccggtgccccagtcagaatggccccataggaacgcagccccacagcctgcagcatcctccctgctacatcaaccccaaagctgggcaacttcagcttgctaaatgtgagtgtatcacgactggcaagtgaccaagtccatgttaccccacttactccccttaatcaaaccatggcagcggccgtaaagactttgtgagttacttgtctttgcttttgtttgtccttccagacaaacaagagcttttgcctttgtagggaagcaacaagctcatggaccaagatgaaaagatgcgcttttctgggtgcaaagcccaagtcagtggcagcagctgtttccctacaactcctcccccacctgccctgccacggccctgctgctggtttccgaacctgagtgcctttttgacttggtttcctccacatgcgttatgggaaaaacaaaaacaaaaaaaaattgctttttcaacttcagggaatattacaagggaagtgcactcctcaaagaggctgggttctggtgtgtgagatgcagtgtgggaagatacactctattcccacttctccggggacgcaccaaagtgggtgagaaggggataggagacctgaaccagcaatggcagagacagtttcatactgcttcctgcactttcccacggtcctcctgcgggaccagagctcctgatctcacctcctgcgagctgagaccagagctgcacgcctgcagcgcggcagctggccagaggaacggagaacggatgacccagcgagttcgtggctgggagcgccactgcagcaggaaagtgtgtgtgtgcgcggcgggcgggcgggcgggcgaggtgggggggttgtatagactggaaaataaagtgcgcgcggggaggggtgtggactggaaaataaagaaaagccggccgggctggggaggcagcggctgagaagaagggcaagccagcccgaggccgccggggaggagatgagaggaggggacttacctgccacgaagactgcttgcaggaggcagaggtagttcttcccgtacttctcggcaatcctcacgcgctgcagggccatggccatgtccacctgcagagggatcgcctgggctatcggcatgaaagtgcagccatctgggttctggggcaggcctgggatcctgccgcaggacactgaggtccacggcgccgaagcggcagcttggggcatgtgcctggccgcccgccttggcgaacccaggtagggccgggcccctgccgctgccatcctcacgctggagagccgggcagggccgctactccagccagcagctgcccagctctgacccgcgcgccgccgctgggcactcaggcactgccggaggggtacagcccctggccccgctcagcccagctgcgccgcggccgccagtcctccggagcccccctagtagggacagaggcgcagaggcccgagagctccgcgcgcgcggagtccaggaacttgttaagagtttggggctctggcggagcgctctggcccccgccgctgcgagggcaactctccctgggtgcgcacacccacgcccccgcttagccaccggtggatgaaaggaggcgggggctgtggaggagggacgcaaggagctaaaagagagaatttctgcagagattcccattttcgagggacgaaaggccaacctaggctagcacttgtggtgggaggagacagcccagcctcgcactctcatggcaactcatgcaagtcttggcggtttcttagcattctggccagtatccacctgggcaaagactcggcgcaagggagttacactgtgtgagcacatgcaggtggccctgtcagggctgctgtctttgcccgaagagaatactagccctgaatagtctgagaggtcctgtgctgaagccgaaatatgtcctccgaggatgcaaacaaacacacagacatactctgatctcagtctttggatatgccaagtcccacgcccttcaggtcccaaacgccaagcctcctgtatagacacttgagctgccatctgccatgggcatgggagacttgacacgctttagagaggacacgagaaaacggaaaggcaagaggaggcaacccgtttaagaagccaaatggaaaatgaaaggagctagagctccttccttgccctgaacccaaagcactcaggga

SEQ ID NO: 9693 - DNA, 1156 bp, artificial
  synthetic oligonucleotide
ggttactgatttcaatctgtccttccacaatccttggcctgtttctttgccagtgtcccttagacactgcctctcatttggggacttgcttcattctcagctccaagtaattcccctcaaacgcttccacagaaccaaggctcactcatccatcactagctgaggcatttttttttcagatatttgtcaatcctaaagtacctgcctaattgcaaccttgttccgagacaaagtaggctccctaactggattcaaaaagcctcttctggagttcagctttccttttctttttctttctttcttttttttttttttttttttttttgagacagtctcgtgctgtcgcccaggctggagtgcaatggtgcattcttagctcactgcaacctctgcctcctgggttcaagcgattttcctgcctcagcctcccaagtagctaggattacaggcacctaccatcatgcctagatatatatatatatatttttttttttttagtagagacagggttttaccatgttggccaggctggtctcgaactcccaacctcaggtgatccacctgccttggcctcccaaagtgctgggattacaggtgtgagccaccacccctagcctggagttcagcgttcaagcaagatggggcaacatgggctgcatttattccgccacatgaagcaacaacaacaacaacaaacagacaacatatatatgaaacagcagtcttaagatgcaaaacatcaggcaatagaggatagtaatcctgggagatgggagatggaacataagatgaatgctacagtgtcccaggttattacactaagagagtttccaggccacactgcatgaaggaggaatccaggtggagacaggcagactttctgagggtttacaataaagtagaagtatgatatatggcagtaatagcacaaaggccaggaggtaagaaatgaaggtatatgattgtgtagttcttatactgtgtgtgaaatgggataacaattggaagtaggctctgagaagatgaagatgtatccaataaaccctaaagcaatcactaaaacaataaaacaaagagatatagctaatgacttaacagaggaaataaaatgaaataataaataaataatcccaaataaggcagaaagagatgagaa

SEQ ID NO: 9694 - DNA, 1659 bp, artificial
  synthetic oligonucleotide
agactgcctgcctacccacgagggccgcgctctttccacttttattcccccggcctccccggatcggcgccctggatgtgatcgacaccatgaagttgccccataatcctctctggcaacataggatgtaaaatttgatcagctcattggatgaagccgacaagtcccaaaaatgtgtgaaaagggggctaagaggtaggcaggcgccgcgttgaggcagcgctcctgccagccccgctccgagttatcggtgctgcagccgcggcgcaagcgggggctgggaccgagctgcggggccgcagcggcggcggcgaccgaggcggcggcggcggcggcggctgggaggccgcggcgccatgggggggccgtaggagcggaccgtggggccggaagggggcatcgcggcggcgccggcggctgcggggttatctccgcggccgcgaaggcagcatccacgccgttgcgggtggctgagccggcgggcggggcggggcgtgcaccagggccgcgggcgactagcgctgtagcagttggcctcagggccccgccgcccgcgcgcccgcccgcccgcagggcggcgcacgcgaaggaggcggcggccgcagaaggaggcggggagctcggagcaggaggtgaggaggtggaggaccaagagtaggcagcagcggcggcggcggaggaggaggcggtggtggaggtgcgcggcctgaagaggaggatggaggagcagcagaaggagggcgaggccgaggtcgcggagcactggttttccaagtgggagcgccagtgcctggctgaggccgagcaggaggagcagctgccccccgagctgcaggaggaggcggctgcagagttggcagggctcaagagcgagaagcagaagctgtggcacctcttccagatctcggccaccgccgttgctcagctttacaaggattctgggtgccaacagcaaggactttccatgtgggaccccttccagaatgcggccatggccgtgaccagcctctacaaagagagcggggatgcccaccaacgaagttttgacttgggtgtccaggttggccaccagcgtcgcatcaaagatgtgctggagtgggtgaaaaagggccggagcaccattcgtcgcgaagacttgattagcttcctgtgtggcaaagtgccccccgctcctcctccacctcgcactcctaggacacccccgaagccacccactggggtcaccagccaggctgtggcaactgagtccagctcatcggtggacgtcgacctgcagcccttccaggaggcgatcgccctgcatggcctcagtggtgctatggccggcatcagcatgcgatcgggcgactcgcctcaagacagcggtgtcgccagcagtgggcgccgaaaaactagcttcttggaggacgacttgaatcccttcgactcagaggaactggccctccacctggacagtggggggatccgcaagcgcacctcggcccaatgcagtgatggcatcacagactccccaatccaaaagcgcaaccgaatggtctaaactgcctcattggttgcctgccgccatattgcttgagagtgaactcaaccgtcgacatgcttgtctaaaggttactggagaccatttttcttcccttctctaagttaaacaaagatttc

SEQ ID NO: 9695 - DNA, 1883 bp, artificial
  synthetic oligonucleotide
tgatgcttgaactgggatgttcagaaggacactggactatttgagaagcaagcttggaaaagaactttctaggcagaggaaatagcaagttcaaaagccctgaggcaagaaagaaacagtgcctttttgtcaatggatgtaattgttaggaaatctgtgcttgatgtgtggatttgggggaaatcctacagatgcaaaaaataaaatatgtactgtgcataataatctttatttaagacaattactagactttaaaatgtgttgagatatgaaactaacacaaaccataatctattcattcaacaaacatttctcaaaaggaatcctggctgaggttgagcgaaggaagactaagaggtccaaggagttgaacccagagaggtaggtaagagctggatcaggcaatgcttttgagagttgggatattttttaaagagcaatcaataggaagccaccagaaagttctttaaaaagtaacaatgaaaggatttatgttgggcaagtggagtgaatgttctagggataatgggttgaagcgggcagagtagaagcagtgagaacaggtagaagaaggccatggcagaggtccaacaagaaatgacagtagtggtgtggatgaggatggtgacgatggaaaggagagacacagcatgttgtatgtattccactcagctggttggtgctcacctaacctctcctctgcctgacctgggaacccacccctgggcttgctctctgcccccttctcaagagggcagtgagggttgattgggcccctgcatttaagcgccttctggttcctcagcggccccagctccccgcagcccaggctgttcagcttggctcccaaggaggtctttttctccagtgagtgggtctgaagaatgacggagccgctcactaatctgatcctgctcctgcttactgaggaggggaattggcagggggttgctctggtgtgcttgtcctgcttgtgttaactgcaggccccaacctggagaaaagctagaggattactgctcctggggctccctgccccctccccatcccaaaacagctgaaggaaaggcttgaacttttctctttcacaaggagacacaattttgtatttgtgatagggagagaatatattttaaacctgccttttctagtgataacaggaatgcaatcctattagagaaaattggaaagtatgagaaggatgactaaccagtattcataacactaccctgcatttttgcatgtttctccagtcgaatatacttattttaaatagtcaaggtcatatacactgaatatagttctgtgtatcttgctgtttatgctttgtgctttaagcttttccttgtgtcattaaaaatttctctgtaaacgattttcatgtctgcaaagcagactttttaaaacattttacctaacctttctccatttgttggacatttggtctgtttggaacttttttgcataagaagggctgtgatgagtatctttgttataaatctttggctgcattttggatgcgcttcttcagccccaaccctcacccactcctagatttctagaagggggattaatgaaggaagttgtatagtcagaagataggaaagcaaaactctacctagggtaattcccaccaaaaagtagctctgcacctatcatagaagctaaaaaatggactagccattttccctcggtaaggacttgatgcttcccacatcacatcattcacgaagaggtggctagtaggagtctctgtgtcaggaattgcctttctctagaggccccgctggattatggctttgaggggcagctggggctgtgatttcactggtttatctcttggttttgtggccggcagaggagagagtaccctcccaggcctg

SEQ ID NO: 9696 - DNA, 9916 bp, artificial
  synthetic oligonucleotide
cgggagactctgtcgcctagggtcccagcggacctcaagcaaagaaacctgtggtcagtagtggatgaggataaaaacagtgcaccaggccaagcttattggaaaggctgagtttagttattctgggatagcgaggtaacaggattaaagggattaaggaaatcacctcaaacagctgaggagggggtaaaaaaacactggttctatttgttttcttcctaggccccaaacagatacactggggccgtgtggctgggcgcgaaactaaaggcccttcggggggcacagtggaatggccaagggtcagggactggaggaaagtggggagggggatggagtggggagggggatggagtagaaagcgggctcgagactctggatgaaaaggagccttctctggaaaacaaataggtggactgagttgacatgttaaaaacaaaacgcctgggaggagtttcggagatctttgaaaatctaaggagtactttttaataccaaatcttccagcgctgaatgttgactccggcggttcagctaccagggttgaaacgtatttgtttcctgctggggatccctgtaaccatttatttttaataggatcatcgagatttccgaagggttttcgttttgtaaatatttcagctaggctcaaatgtcttcccgccccagtgcacaaaggtaaaagtgccccgtttttggtcggtttcagcggccgcgcctttccagccccgcctcgcgtggctgcggcagcagacactttcagcagacgctcactgcgatcaacaagtgcgcggccgcgggctctgcgcattagctactactgtgtgcccgctctcgggagacgctcctggaagactcggaactctgttccgagtttcagttgagaatattggaagctggtgtatggtggatcaccagtagttaaaaggaaaccatttcagattatgcttgcctccccccaggtcccaccccgcccctaggatgggatctcagttgtaaaaccgagtgttggttcctccccaacctgcaaaaaagtttcagggccgcaaaattatcaggactccatcatgttggttataaaatttattgatctcatttaggaattaagagtaaaagcttgaaaaccctgaaacaaagtagcccctccccactacccaaacgaaatctgaacacattagcgcgaagaaatatcaaacagatcacggcagaaatcaccaactcaacatgattggacagaagctgtcccgcggccaggggcggcgaggcgggagacacacgcacacctggctataaattaacattggctttagctgccgcgctgcttggagcggtcagcgccccaaaaaaccacgaggaaaacagacgcgacacgactgggggcgtaggcgttgcagttctccagctggcctcacccgatactatgtttctcccattcactccttggctaactgcaaactaacaagacaacattttcaaatgtaacagaataaccctggaactcaggaggaggagtgggggctgttttttctttgcaaataacacagcgattcccagcctacaaaggtgaaaggagcagcggcgtggggcaagagagctctctagaagtcccattttcgctgctcctgacttatttttgcttttgtacaaaacccgacagctacagcaaaactttcagccctccccatcatcggtacaaggcaacagtcccaggcaagcaaagctaaacaaggcgtcccaacttgggggtgcggggcgggagtgggggtgggggtggggaacaagggtggacgagcgcaggccggtgctcagatgtgggtcagcggcaccgttccgttgactgcagtcccggcgccctggtagtgctggtgcacgccgtgcaggcgaccgccgggcagcggagaggcggcgtcggccgcgtccccgccgggtggcaggtacatgctgatcatgtcgcgcaggtcgccgaggcacgcgcgctgagagtgcgatgcgatggcgggcggcggcgagctgggctcagacttcactaccgagcccatggggcccaggctcatggcggctgcggccgcagctgcggccgcggcggtggcgggctgctgcccgtaggcggcggccgcggctgctgtggctgagggcgccatgcccccgtagcccgaggcggcggcggccgcggcagcgacgttcatgtagctctgagcgccgggcggcatcattgggctgtactgcaggccggccatgtcgtagcggtgcatcggcggcagcgcgggcggcggcggcgggctgctcatgctcgggggctgcgcgtagcccagctgctcctgcaccagcgagtacgcgccgttggcccagccgttcacgtgcgtgtacgtgtccaggcgctggcccacgcccaccggactgctggcggcagcggctgcggccgcggcagcggcggcggcggccgcggcaccgggaggcaggaggccgctgggcagggagtacttatctttcttgagcagcgtcttggtcttgcggcgcggtcggtacttgtagtccggatactccttcatgtgcacggcgcgaagtcgcttggcctcgtcgatgaatggtcgcttctcggcgtcggtcagcagtttccagtcggcgcccaagcgcttgctgatctcagaattgtgcatcttggggttctccagggccattttgcgccgctgcccgcgggaccataccatgaaggcgttcatgggccgtttcacacggtcctggtctgtacccccgccacctccgctcgcaccaccgctgctgccgccgcccgagttcgcgccgccggctgcgttcgcactactcttgcctgcgcctcccggggctgcggggccgccggtgcccgccgcttgtgtgggtgtccctacggggttcttgagttcagtctccagaaggctgtacattgccggggcgggaagaaggtgcgccagcgtggcgggaggagaaggcgctcccggggctggagcggccacggtgaaaaggccctgggactccgtcggagcggagcttgggggcctgtgggccagcgagtccggcgggaagggtaggcttatcaaaatgctccgcgccaaatcagcaggaacccgcgggcttctcgcacctgatgagttctctcgaacaggtcgcattcacagtctgcctgggctctagctgggccccttatatacctgctcggattccccggggttggggcttggtccgcccctcgcaacccggaggacccgtgattgacaggttcgcagtgatgcgccctggccaatcattaccgagcccccgttcggcctggctggaaaaaaaaaagttcggggagccctttcgttcaccccacgcccctctttggcctagtgacgtggtaagagttacttaggaggcgggagtccacgaggcccactcagaggccaccaattagggtttcaaaaagtttgaaagaacgaaacctgaggaggtgacggggggaggggggagggggcacgcaagcagattggggggagggggcagaggggcgccttcggaatttagaaaacaactttgcaaccctgtcaaggcagaccggcgccccatcccccggccagcccgcaaagcttcccgttgtctgcacggaggttttctggccgcttctgctgccagcgctaggaacgcagggcaccaccagctacccaggccggcttagggactccaggctcattggaagtgctcctggctgcgtctccaagaagctctccctggaattggccgctggttgtccagatctttctctaggagggccagtgcgtccaggacgcagcgtgggtcaggggcccgggcatgggagacaggcttcaggactgcggggtgcattcggctgtgaggctcttgggggtttgcaggagggcgggcaagcagtcagtcgcccgtctcctgagcctgtcggaggcgctcgcacaaggtggtgtggaaagtatgtgtgggacgtagggggtgaactggcctccgctctctcgatcctggcccccgcttagcggcccctttttgtctctgctctgtggccatttcggtttttccagtccgatgcccctgagggggagggtcgggccccttggaaaatccgttttcatggcaacacggagcctctcagagtgaaagaaaagtttcttggaggggggaacgttggccggagcggagccgaggccgtcctccgggcgaaccgccgggccccctccactgcccccgcacctgccgggaccgctgagcgctactctgggcgcgcagcctcgccgcctcccccgggagcaggctctgctaacggattccgtccgtctcttttattgttttagagacttcctgagattcggagcgggacattcacttgcttgttgggttatctgccaaagactagcggcgcgggaactctggctgcggggagaggaaaccccgataatcgccactgccagctgaagcgagtggcacagcgtttgaaactctcggagcagcccgaggtagcgagtgggaatgagaagccatcccggcagatttggcagaaactaaaataaggtgtccatacggtgtggggtctcgcccccccatcatccctagccccgtggaaaggtggggaactaaacggaaagcataatcttaagtgggtggggggcgcatgggggaatcccaggtttctagcgtcttagcgttaatgcaagaccaggcgatcccgggacttctgcatgctgggctcttccccctttctctccacgaattaaaaagtacgcctcttcggcttgttagtggggtcagggggggagtggaggctcagggcaggccagccccctctcggccaggcggacctctggcaaaagaatcccggctcccagtcggcatcatctctcggaagtttggggtctggaaacttgccccttaagtttgtgttccacttgatctgagtattctgcagccaagggctgcagtcaactggatgggtatacggatttagggttttaaatgtaagtaaactctctggaaggcttctgtgtgtagatacagtgtgtgtgtgtgtgtgtgtgtgtgtgtgtgtgtgcgcgcgcgcgcgcgcgcgcgtagcgaacgtgagctgataagtacgtctcagaaaacataatgattaggcaatccctacctgcacctgttttcttggcgaagtggccgacaaggtcaaactttcttaggcaaatccatcctctcctacagaagccaatgtgcaatatctctgccctcctgccgtctttcccgcatgccctctctgggcttttctgggccctggaggctgttgctaagtgaagcgcgttttaggaaactacccaaccgacgcgcggcctggcgtccagtagcttcacagatgtcaggtttctttccaagttttaggacccaagtaaacgttgcagtgacagcgcctgggctgcatatttcccaaggcaggggatacggtgctgggccgacaccctccccgcagcagattaccaggggaaactagtcactgctcccagctgtctgacatttgatcacacttagcccgaggcttaggtgagctcatttttgccctacatcctcctgccagatttacagcagtcttttgccaggaccaggcacactctcccaattctcccggcttctcgctgaggccagctccctctcggggggtagatacataaaatctccgtatctggtggttctggggtgatctgcacattctcaagtaagagccacgccagatttccttggaaactcttgccaggacactttctaaatacaagctatcatttcaatagacaagcaaggttaccattgcgggcgtggggagatgggggaaggctggaaataaatcagttcttagcccacctgcagcgcaggcttagccaccagcccagcggcgcaaccttcgctaagggtcgggagaggtgtcgcgacaggtaccacagcgcaggaggcctcggttccggctggggctgcgggaaggcagggcagctggcggagccccaactccagtgtctccgacgcgcaccctgcacccagcgaggaaagcagaggaacgcagtgggaaccaggaccgatccttcaacctcttcaggagaagagagcgcgctcagcagctctctcgccctctccagcctccaagtgcccttgggcggttcacagagctccggatctggcgctgggaacccgaccaaggcctcctccccattcccccgcccttcctagagagctcccgctccctccgactggagccagccctggggctcccagaacccagggcgcgacaatagcgccgtttgttggcttcggttggaaacttcacccagcgtagcctcttgccgcttcgccctgcggggcttggaggtcgccccaaccttcgaaagagaccaagcggatttgcggcggagcagatgtgatgcctatccttagagggcgggttatagcaaaactccgggaccaagactctagcgtgactggcccaatgggctttgggtacatagggcacccctgctctgccttcttcctatttctaggcttggccgacatcaggtgtcccaagtgccttatatctgcaaagaacactcagcaattgtgccttagagctactggtggaaagagcaggaaaggagctgtcccacgactcgcgcggaggtatctgcattgattcctcttcagtaactgctcataggggacctttttcaaggtccctggcatgattaggacccaacttattagaagaggtgccctcagccgggcgcggtggctcaagcctgtaataccagcactttgggaggccgaggcgggtggattacctaaggtcaggagctcgagaccagactggcctacatggcgaaaccccgtctctactaaaagtacaaaaattagcctggcttggtggcgtgcgcctgtaatcccagctactcaggaggctgaggcaggagaatcccttgaacccgggaggcggaggttgcagtgagccgagattgcgccactgcactccagccagggcgacaagagcgagagactccgtctcaaaaaaaaaaaaaaaaaagaaaagaaaagaaggagaagaagaagaagggtgtcctctgcgtgctgggtggtttggggccgatgtgtgtctgtgtcgcttgggggacggagagtcggagagtggggtggggtgggcggtatttgggctcgcctgggcccgctgaagcctgacaatagggtcagcaaaggttgccctccggctgtggcctagcgttcgcctttcaggtttctcaagtgtagccaagcccagctcggggtctggcttttaggaagtgagaacaacttatcctggggactctcggagacgccttgattttcaacagacaaacaaaaccaaaaacaaacccgcaacagtttgcgtttcttaaagcagtcatttctatcttttcccttgagaacaccccttgtctgtttactctggcttctagccaagattgtgtatttaggccgctgatcgagagccttgatcaaaaaatcataggcttaggtctattgtagaaccatcccttgtaaaaaaaaaaaaaaaaaaaggtcagaaaggtcaccatcatttcaacggggtggtagagacagcaccttccagttcctggagcattcagtaggaaccccagccccactccgccaacgcgtagcaccgtctccagcggaagtactctttcttacaggtcacagaagcagctgaagaccctaggctggtgggtgtagattgtaataacttagtcgatggtctctaaagaaaggttgctaggagctgcgaggtatgggaaaacaaggtcctcgaggtaccataaagtctcctgcgggctgtacaactgtattctatcgtagtttggtgttgctcttttttgggagggtgcgggggtacttttaaaaaagtttccgcattcaattcacttggttggctgagctgtacttggaaaatacactgggagtcccctcggcccacacgttggcgctcagtttccttccacccacagagtattcaggtgttaatcaccagctctcttttccctatgtgcgcagcaactccaaggaatttgacaacctttgccttctgcttttactcgctgacctcaccacccgaaagttgccattttcccggaggaaggaaggctctgcccatgcactgggtcccatttccagcgggctttgctgagccatcgctgtcagcctctttgcctctcacccccctcctacacccgtctttgcccatccccacaactctcctcacgcgctcagctccgcagactgccaaacccccacccctgcggagcaactcggggaactcggccccctacgtccaggcctgccctcccactgggcctgttgccctttccacttccttttgtgactgcagaggcacagcgctcacctgtacagaggcgaggtgacctgcaggaagccggggccaataaagtaatcttaaaatcgttatcagtatgcaatgctgtttgagtttttccatgtctccacaattccattcgggtccaccaggcaaggcagcgcttctcgggaaagggtgcctggaaaatcagtggacctccaggcacttccagcgtgaccaagcaaagctatcgccccaaccacagggggcgcaggatggcagggggttgggtagagcatcctggagaaaattttaaattcgaaggcagcactcagcggttccttttccactcttttatttatttctttgtttttctttttatttatcattttcttttaagagagtggaaagccgtggaatttggtgcgcagaatttctatgttctcttttcatctcttcaacgccctcattttttttttttttttttcatttcactaacctttgtcatccacctgctatgtgctgagttgtgcaccaagtacgggacggagaccctgcactttcccattccgtatcagatagtggcaatggcttgggaaagtctcaagaggactccggattcggagagaaagaaattttcgcctgatgctaccccatccccctagttgatctacggagaaatcgggcctcgcgagaagcgcaacatcttggacaaggacctggcgtgagcggggtcgctacgccccgacctgcaggggccacgctcattccccagcgcgcgcgcgctttcccacggcggcgcagagtccagctagcggagaggcggagggggaagcgcccgcgtgcctggagccctggcggtccagcgtcccggcgttgccgtctgagtggcctaaaagggaggctctggggccgctgctcgcgacggagagcggggacgcggcccaggaacagctaacgtgccgcttgctgcttgccaggtatggaggatgcctatcctcaggcagacccgtttccccgcgggctggcggccagacggcgcgacaaaatgagatctgtcgagaggtctggccgtgatggctttttggcgtctaggccgctgtcatcccaattccatttctccgaaaagcatcgccgagttaggacgtcggggctttgctaatgtgatgtttgtgtaattaacaccatctccccttgtttctgaacatatttcctcccgcagcacagaccagctttcatttgaaaaagcaacgggaagaacgtcccaataaccctttctaatgggaaaaaactgccccttttgtggaatggtttctttacaaagccaacaaccaaccttattttctagttccaatggctatccctttatgagttatattattaaagaaatccgacactaattgtgccgatttaacttgttaattagttgcaaataaactattcattagtggtaaaataaaataaaacccatgtgtctagatatcattccacattcacatattgtagtgtctgcataacataggcatactaaattaagttcctaaaaggtttctcctcaggata

SEQ ID NO: 9697 - DNA, 1467 bp, artificial
  synthetic oligonucleotide
taggtaaagttaacatgtagagtattatttgtccattttaaatgatattaatttttatcattggtcttacatgaccaaagaataataataatataataataataataataataataacaacaacaacacttaacatagcatttgctacatccaggcactgttctcagatccttacatgcattaactcatttaatctatttaatcttcacaacaacccattgaagctaggtaccatcattatccctattttacagatgaggaaactggcacacagaggtgaagtaaattttgtccacaggacacaactactaaataatggagccagatttaaacccggctagcctgttgtgagagtccatgattgtaaccactatgctataatatctgctgtttaaaatcatgatagaatgatgtgatccaaaggttgattgcttccacattttgtgtagaatattatacaatcccgtatacaaatggtctcgcttgatcctgtcactgccagagtctgtttgtatgcacagcttttattccccaaccagctactaccattcccttggacctgtatatggaagtaggtgcaaacactttctgataccattttcagttttggcaggaagaatataaggaagcactgagttcaattaccctttgcttcagaatcatattcatagctccatgcttcgagtactggtgcttggaatttaactcttctatctatttgaatccccttttactgacttttgtccagtttgcaccttactatgtggagcacttaccattagtttgtttctaacctccagcatctacctgcttcaaatatcgcaacctcctgggttcctggccactgccttgtatccgactaatggtagctgcaactccttaaatcccagcatgctgatctggagaaccaagtagttggttctctaagtctcagctcccaccaggtgccttcagcaatgttgctacccatgcttctggctggcatgaaaagcatgaaaaccacataattaaatttttacagttaggcagggactctctaaagatttaaaatcctctatgtgataacaaaaaggaacaatgataatgccaattaaaatagaaataccttctgaatgtctaatgatttatactttacaaagtgctgtcacctcattcattcaacaaatatttattgagcgctaactgtatgccaggcatgttttgataaagcttaaaatcgtctgtgggaaacaacatacagataattggaaaattatttatcaattgttaaggccatgaagaaaaagtaactgagagtctggaaaatcaaggaaagcattcctaaagaagtaatatttattgtgactctgaagaatctatattgtcatttggttctcacaatatagccttgtgacttaaataaaacagattttttgtatatcagttttactaatctgagtgctaacaatagccatgggacccagctgt

SEQ ID NO: 9698 - DNA, 630 bp, artificial
  synthetic oligonucleotide
aaattgagattccaaaaataaacctatacatttgtgaattgcatttcaataagggccccaagagacttcgaggagaaaataatagtcttctcaacaaatggtgtcaggacaactagatctccatatacaaaataatgaagttgaactactacctcatactgtatatgaaaattagttcaaaatggaccaaagacctacatgtaagagctaaaactgtaaaactctatgaaccatgaaaacataaatgtaaaacatgaaatctgtgaaaacataggtgttaattgttgtgaccccggattaggcaatgatttcttaaacatgacatgaaaagcacaatcaatgaaaaaaacagataaattggactacatcaaaattaaacatttttgtgcatcaaaggatactatgaagaatgtgtaaagccaatcgattaatgggagaaaatatttgtaaatcatgtatctgataattgtctagtatctaaaatatataaggaactcctataactcaacaatgaaaagacagtccattttttaaaagtaggtatttctccaacaaaagatatacaaatgtcccataagcacatgaaaaaatgctcaccatcattaaacattagtgaaatgtgggtaaaaa

SEQ ID NO: 9699 - DNA, 1161 bp, artificial
  synthetic oligonucleotide
tcaccaaagaaagcgatcccttagcccagatcttggcaagaaccagtgtcaaagggatgttcatccagtaatcctgaattgttggacacccaagaagagaatcaagatgaaaatctgtgcagttctgtgagatttctgtagtactttgttctgcttacacttcaaaagcaagctagactttcaacttagtatagcattgtcatttccactgatgtatttcctgagtatagataccaactctcctgatttcctcaggactaaaggagtttctgggacaagaaaattatagttttaaaaacaggacagccccagcaaactgggacaagttggtcacactatgcatgaggatgtgtatatatgcatatttttatgtatgctaattcatattataatttacataccatatttatactaggaatcaggtgtgttaaatcccatgatacacatatgtttatactccaaaatctatgtaattaccatctatttctaaaaaacattctagaaacaaaagtaattatgaaaggctattttactatattttggaccatatatcatcataccatatttaggacctcatttgttaaggctaactacctgaatatcttgagcagccacaagtttagcccatttcatgggactcattatagcaagtgttcatttctcccaccctctgttcatgtccccagttatatgaacaggaattttttgttagaatagaacaaattctttatttttgctatgttacagataatggaaaagcttgcatacatggccactttggaggatagacacttttcctcatttaacaaaatagtgtgaatacataagaccatgccatcatttttattaatcaaagctgttaccttttctgaaagaattgttctatttccttgagctcattgtgatgaatcttgagtctcccctcaagaattaagctgtgttctggaagatgaaaagcagccctccccaaagttataccaagacatattggaatatgcttttctattatatctagatatctggatggaaaaattagactggggatttattttaaaaagagagacatttcatacttggtatttgaaaatacgctagcacagctcttggaaataaacagtaatctaacaattctggtatgatatcctactgcccaatgttgtt

SEQ ID NO: 9700 - DNA, 1177 bp, artificial
  synthetic oligonucleotide
gggtagaaactctgcattatttgcaggcggatagttgtaaccccaattctgttgtctacgtaggtttgcaatacattgctatttgaatgaatacagtaattaatgtaaacctgttcaaacaggtgctggtgaggccgtggccaaacgggaaggcatctacactgttgatgggaatgtaaattagttaagccactgtggaaagcagtgtagagatttctcaaagaacttaaaacagtactacaactcaacccagcaatcccattactggatataaatccaaaagaaaatagatcattctggtaaaaagacacacgcactcatatgctcatcacaacactattcacaatagcaaagatgtggaatcaacctaagtacacatcaacagtggactggataaaaaaaaatgtgatacatatataccatggaatactatgcagcaataaacaagaatgagatcacgtcctttgcagggacatggatgcagctggaggccattatcctaagcaaactaatgcagggacagaaaaccaaataccgcatgttctcacttataagtgggagctaaacaatgagaaatcatggacgctaagagggaaaagacagacactgggccctacttaatggtaaagggtgggaggagggagaggatcagaaaaaatacctgtcaagtactgtgcttattacctgggtaataatttctataccagatctccatgacatgcagttcacctatataacaaacctgcacatatacccctgaacctaaaataaaagtttagaaaagcatattccacaagacaagcctggggaaaaatgaacatcccaagaaatcatgtttagtttaaatttcaccaccttcaccacaaacagattttcagtttagtacaatattcaactaaataacaaaatgctagttgctttattcaatatctattcagcaaaattatcaaatgtacacttcttttcctactctatgcctcttgctgaagaagatgagagtcactgattatacaatgataattatgtacttttatgattgaaagcaaaccggatttgaagtcatttttttaaatctgtatgttccatttaataactatgtaaccttgaataaattatttattccccctgagcctcagtttttataggtgtgaaatggagataatagttcttgcttaaa

SEQ ID NO: 9701 - DNA, 623 bp, artificial
  synthetic oligonucleotide
tttgacactgacactttacagggacagtacaataaagaaaaattataggcctatctcattaattagaatatatgtatatatataaaaacaatcctcaataaaatgttaatatttattctaacaatgcatgaaaaatatgatgcatcataataaattaatatctaaccaggcattgtgaggatgattttatattagaaaaccaattactaaaattcaaaatttagtgtccattcataataaagctagagaacataacaagcacaataattaatatatcccacataataaatcatagagaactagaattataggagtttctgtaattcataatgtgtgtcgattagaaatctataatgaacgttgtgtttagcattatttctttaaaagctgtcatttacaagtcaggatcacgtcaaggatgccttgtatcatcgcttcagttcaggatagtaatggatttcctagtttgtgcaataagacatgaaaaagaaataagtgctacaaggggtttgtaaaggacataaaaatcattaatttatagatggcttgattgtctacataagaaaatcctagactacagaaacaattagagttaataaaaatccattaaatttgttatatgc

SEQ ID NO: 9702 - DNA, 1497 bp, artificial
  synthetic oligonucleotide
agtggtcctctgatctccccattcccttctagcactcccatatcctacaaacagagaacgataggttcctttacttcaaatcagcctggcaggatcagctacagagcagctgggatcaaagcagctgtgcttcaaaggtcttaaccttcatcaactgcaactgcaaccaaggagccagatagcaacctttctcgtgccttcattatgatggatcctgcccttgccaccatgggtaggctataaatgcacacatcttgctacccctgtgatgtgattctagttcttagcacttgggattgacacaaaagaatgggatacctacagagcataatccattgtcaagaatacagaatatggcttcctgatgtatggtgattacagaagaaatgaaggaagtgcatgctaagagaacataggaaaagtcagtaggtcggcacagaaattgaatctgctaagagagtggagagtcagaacataactattactattgcctaggtttcttcctgccagctctgccactaaatagatgtatgttcttgggaaagtaattcaatctccctgagcctatttccttattttaaaaattggaataataccaaaatcgacctcacccttaaatgacgtgatgcgaataacgcatgtaattttgcacatagtcagtgttcaataaatgcttcttcagcattcacaagtcccttaccacatttactcccaggtttaattcttgttttgttgcttcctctccctcaacctctctagcaaattaaaatcaacagtacgagatgaccaggccatcagacacaatatgcttctaatttgcgctttgctgaagtagtggtaatgcatcagtctatcagctggaaaactagcttaattaattggcttcactgcgcggtggctgctacagtccataaaaatttcttaggataccaatatccatgggtaggaaatcaagcactttgtccaaaaagaggtagatcacagctcctgctgtaatgaagggataagtatgctttattttaggctctggggatttccaggagctctccatataatcctttgaacctccccacatgcctgaaaactgttaacaaatctctgacagaaggtttgtcatgcaatattgtaagagcttgttgtaaagatcttatattgagctttcactgggctacgtccaatggacttgaggttcctccaagcctgatttgtaaagtgattttcattattagtgaacacgcatgacaagacagccacgaggagggatggaaaagaaaagagagagctactggagtggaaattcccaggaggtgtcgggggagatgcatggtaaatgagaagtgaaaggctgcagggaatagaaaattgactgtgaaaagaaaatcaagggctagatttcagaagagaaaacaaaaacataaacaaaatcacattagccttgtcccatagacttgatcatctcacattaggtggaaatataaaagccagaagttaggatga

SEQ ID NO: 9703 - DNA, 1342 bp, artificial
  synthetic oligonucleotide
agtggtaaaaccgaacatgtctcaaggtagacaacccattagccatgacccaggaggatttgcattttaagtagtttggttcagaatacagccagcactgctgagatgctatttggctgccatatagacgtgcatttcccctattcaccatgagagcatgattggcattgcaaaaagaagtcataattcttaactatgacatcacctaaagcaactttcattgtaaaatcaaaatttcacttgatattttttgccttgttatgaatgtggttttcaacagctattttggttcagttgagtcatttcttgttactaaaccaccaccccacccacctcaaaacaaagaaacccaaaagcaaccaaactaaaaaccaaacgcagaaaaaaaaaaatccttataatccgaattcagtacaaaaacaagaaccaggaatctcaacacatctgaaaatgcataaggagctgccctcctcctggtgattgctactttaagtagcaagggggggaaaaggcactagtaagagccaggaagttcccaaatgcagctcttgtgaaacagaggaagccacaagcagctggaggggcaggcaagagagagaaagagtccagttggtccaccaaggagagaggaaaagaggtactgaaagggcaagagaccatggaaatgtggagaaaggaagaaaaagaactcggagaagggagctacaaagagggtaaagggagcactgaatgtatgcgaataaagcctcacactccggtggtaccactgaaacatgcacatttaaacatcaagggaaaaacgcaaaaaagaaaagaaaaagcccacaaagtaccagctgggtaccaagagccttctctgtggctgctgggagctgtccgtcttcctctcggtgccctgaaagacccttggctctcacgaccagccaggactgaacaaacctagcccgaccaaaaacaaatcctgcatccaccggagtgcagcgcctggcactccgcgactgggaggagagaagcggcctgaggggggcagaacactgatgggcttcagggcggtgggccgaggtggctccccgagagctccctcgggaaaccccgctggcccgcctaaggctcggatggaggtggaagaggttcgcggagagacccggccattgccgcccgggtgcgctacctcgggcgggcggcgaggaggctggaggggctgctggcgcgtaccgcaatgttttgccgcatccctgttcccggagccggccgctcagccccctccgcgtcaggggcccaagcagcagcctggcggtccgtgtagcggaggcggggtaccgcgcgggatgtcgcgggggcc

SEQ ID NO: 9704 - DNA, 1578 bp, artificial
  synthetic oligonucleotide
atggatatattttaggcagggattatatttaaaatagttaacaaccctaaggtgcaggaactgactggtcagatgggcattctgtatactccccagtatgactctaccagctaaccaggagtttttatcttaggccacactctaactcagatacatgtctcactgtgtaaatagccacagtgagagcaatgctcactttcttagagagttaattttactcagtttttgaaatggtggatgaatccattacatggcatttaatggaattaaatgccaaatttataattatatctagcataaaacttgggacttcaaaaagatactgagttcacttgtccacttaaggctatatgcccagtctttctggaggatatgttctttcttcacaatttagggagaggtttgagaaatattttaagatgtctgtgaaaggaatttattaaccccataatgcttggatctaacaaggaagagtagaagcattcattctctccttcgtgcctgtgtgattggttgtatcccatatctcattgaaaaacttatataaaccttaattcttggatgggggaggtcttggcatgctagaaaagaaagtcaccacatgagaaaaatgtgctaggagaaaggagcacatagaggaatttgtcatagattggattctgtataaagcagatactgagacagagattagtatgcaagatgtctaataaggaatgtctttgggattaacaccagtggaagggaagagaaagaagctgaattgggtagagggaaaagttggtctgtgagtctcaacaaaggcttcagccaatgccatgaggagttctgaagctgggatgatcctttagaatgttctgagtttgggcaagggttctgggcttttgtactgctgcagtaattattaaggggatatgggctgccccaggaagatggggatgtgactttaagaaaggtggatctcttcagttgaggcaattccagttgaggactgacaattgagtgctaccttgccgcctacactcttgttagttggaggaataaatctttcagttctgaaggaaggatctgagtgaagcatcgcaatactcactgtaggacagttctacgcacgttggggcattacccagctgggattttcagcagtccactttccaagggttaaattaagtgtggcttgtatgcagatgtactgattctggagctctcagatctctgcagcctcaattgcagaacttatggtcaagagactaaatgttcctttctgtaaaattccgcattctccttcatccaagaaataagtattgagtgtgtaaaatgtgtcaagcactgctctagctacttctagacacttgggatgcagcagttgaggaaggcaaacatggttctttcccttcaggtgtctacagattttaagggaataaaatttgttcttgaaatagctaatcctagtaatttggtaaatgtcagctattcttctcgtgagctaagcagaaataaaaacagagaggtagaaatgggtcattccatgtgtatttttcaaggatttgagaagctccaatttaagatgtcattgaaatg

SEQ ID NO: 9705 - DNA, 394 bp, artificial
  synthetic oligonucleotide
tagaatttctaaatttagaacatgtgtattttaaacaaaaatcagctttttaaatttcagcatttaattacataatattttaataggagatagaaatgtttaacctttaaattctgcacatatgtggtgtatatgcaggaatatttccacatctctcaatcacatgcaggctttaatccatttaagtattgaattaaaaaaaattccccactaacagatgtatcagaagccaaaacaactggttagctaattaatacaaaaatgcctgaaactaagaatatgttcatacttaaaatagtaattactggtttatgctcatgagattgatgaatatctatctactctgtggtgatatagttaaccaagttaagacttcaggttcaaaataacaatt

SEQ ID NO: 9706 - DNA, 842 bp, artificial
  synthetic oligonucleotide
gaaggcaacactgtcatgacgcagagcttcaggacagtcacagatcacactgtaaggttctggaacaaaggaaccaagttttttcaattttctgggaagggtttttggcaatctgcatagcacacttgttatggtcttaccaagcactttaaaaaaagcacgtctatccacgcaacatttataaaagccaacgtacttgatgatgtttaaagtctctggacagaatatgaaaaccaggcctgaactgtcactaggaaagtgagagaaaactcaacattattttgtgagacactaatgatctcttacctctttagtgagaggtttggacgttcaatttgactatctaatttaccctggcaactggagcacagaggcctcatccttctgccagagagtagcattaaacaatagtggttgtgtgttctaatgagttttttttatgattatgattccgtcataccaaccccaccccctgcctgagcacaaaagacttcaggggatatggcagacatcacatatgccactgctccccagtgtcaatactatgcataaacttcggatgttgcacgatgcagcctgtcttcctctgggcatgaacgtctgcggagccactgtgtgtgtgaacatgtttttattccaaaaagcttctcattcagtggctactgaacttcgttgataagccacactggaaagggaagctggcatgcaagtggtagcatcttgcaggcagcactgtgacatttacttttccctcgccatacccataaaaatccccagattaaatttggtttgccttttatttcttctgacaccctatgctggcttttcattgcagagacttt

SEQ ID NO: 9707 - DNA, 317 bp, artificial
  synthetic oligonucleotide
ctaaatgaaatttctggggaatatgtgttttatagatagaaacatccatgtatcatgcacttaaaatgtgttgaggatgtgctatgggccttacatgtattatttaacactcacaacagactcatcagaaaagggccattgttatttccccttctacagatgcagaaattggggcaagtaggattaagtaactgttgacaatcacataaccaagtaagaaaactccccactcacaaaccagagaaaaaaatataaaatagaaaatacacgaccaaaatacatcatctgttcaaggctcgtgtgaataaatctaaaaa

SEQ ID NO: 9708 - DNA, 1454 bp, artificial
  synthetic oligonucleotide
ggcagaaaggacaaaagtcatttctgggccaaagctagcatgtatccccaccaatttatttcttttcctgctaagtgactagggacattctatgatggattttccatcagcttctgtctctgaatggccatgtggagctatgacttctgccactccctgttggacagggagcacaagtgagaaatcacatctttgttttcataagccactgggatttctaggttaatttgttatggcagcatgccctattctcaataatacaggtacatagaatactattgtatgtataataccctgtatttacaatttcctattatatgatattttaattgtttttactattttactagtataagcaatgctctgatggcacttattaatatgtaatatttgcagaaattaatgatgattttcttaagataaattctcagagataaaattatggagtaaaataatttggagattgtaaaagatttactatatgtgtccaaattgacctccagaaaggtaatgccaatttatagtgccattatcagtacatatgagtgctagttttgccatgcctcgccaaactgggtatttttgttctttagaataattgcaaatttaatagttaaaaactattttggcttcaaatcagattcattttagtagcaacatgaccttaattgtggcagatttttactgaagctgtttcctaatggctcttggtatagagcttaagtaaattgaagatgaaggtagaacctattcagtacaaaaacttttggaaatacagtagagacgaatttgtcaatgtatctggatgtctcaaggacgtatgttaaggcaacaatgaagtgattgaataattgcattttttttccagaattttttttcctttgctctatctagacatttattgctgtactatgagaaaaaatatgtatatgatggctgatttcctgaaacactttacagatcctaggagagctcattgctgtagtctttgttcattaaaaactaaaaaaaaaaaaaaaaaatctgactccttcctgcatcattccaccccaaggatttaaggaataatacatcttaatatagtagagagtccaaaaatgaatatattcctattgaaaggctgaggtcacagtagaactgtgtcctgagtgcctggcacatagtaagtcttcaaagtgcttagagaaacaaagggaggaagaaaagaaggaagaaagaaaggaagagaagaaaagtactatgtcacatatttggaacaagaagggaatggagacatgactctatataatccttttatttgaaatttaactcaaataaattaagtgtggtcttcatggttccaagctcataggtaggaagtagttggagtgggatacaagcccagatcttttattcccatctagtgtttctattgcattgagtagcttgttgttatttctctgccacctaagtaa

SEQ ID NO: 9709 - DNA, 164 bp, artificial
  synthetic oligonucleotide
gatttacagtgacaaagtcaataaacattacactttttttttcaaataatggctcatttctgtatatctctactatggcgaatgaccccctaaggtgagaaacttttttagatgatgataaaagcttgctttgggaatagagggaaaagagttaagaggaacaa

SEQ ID NO: 9710 - DNA, 799 bp, artificial
  synthetic oligonucleotide
aataaatcaatatccaggcaatgggttaaatttagaagtttatgcttgaaaaaatattcaatatgtcagtaggtgagttttcttgcctgagcttgaaacaatgctgtgaactcatccttccatcttttctaaatatcttattgcaaaggaactcttgccaaaacacacaaccaccaactttcctctaattagcccttaaggaattgtttttaaagtcttaattttcaggaaacagatgtaaacctaacttctaattatgaaagacataggcttctttttccatttttttttctttttatttcatttgctgacaagtgagacaacccactgtgttttcttcaaggataattttccaaaggcaaaggaggggttggaaagcaattgagctctttcatgaatggagattgtaaaaaacgcaaatacagagcatttagtcttgcctcaggaaataattccatacttatacctcaaattatgcatgtgctcagagcagtcagaaacatatgcatgcgtgtacatgtgtgtgtggacacatgagcacacattaacattagtggtaaatagaagagaggattaatgaaaaccaaccgtgataaagagagtaaaatagctcattaatataatgctgttatatcaaacacatgggatgaactgtagaattggattatgatacagcacttgcatttttagaggcagaaagagaaagactctagagatctgggtacctgcttgaggacagatctcagatacagaagtgattcttaatagtatttacaatatacattctctccttatattt

SEQ ID NO: 9711 - DNA, 1026 bp, artificial
  synthetic oligonucleotide
ccatactcacaggcctgggctcaggtacctgctccactactcagtaatttgtgacgatgagctaggcccttaacttttataaacctcacatacttcacctgtaaactagagattataatatggctgtatgccttattctgctctgaatttgggagataataaaatgagataagaaatgagtatgctttggaaactctttaaaaataagattaaaattgcatagctctcctctccttacaaaggaaggggtgtgtgtgtgaatttctacagtgctgatgtgtagttagagatgttggtgttactcaaaacagatactatgtttcttagccacagaagattaagtgcttctggacaactgttattttatagttaggtctgaaggggagggaaggaacctctcatcagcatatactctgattggatggcaattagcagattgcagctgccagtaatttataactattttctcatctttacagatgaggacagtgaggctcaaatattatttcaagtccaaggatgtagcgtttacacatgtatcaaattatcacactgtacactttgaatatatacaatctttgtcaattaaatatttttaagtaacaataaataaaaaaactccaaagcaaatctggataagacttaagtgataaaaggatgaaaaaaatagccttccagactgggtacaaaatattgtggtaggttacacttcggaagataaactgtgaaaagaaaatacattcttatctcaaggaatagttgaactattcaactagagaaagctaatgaagttagagctagacatgaaaaagagaatgccagaggcccctttttttttttttttttttttttttaaggaatgaacatcctttgaaacaaaaaagatgaacgttagttgaagcaagaaaatcaaggttcagtttcctggatttaaaagacatttcatcaaggacacttaactacatagtagcaaataactgacctaagatcacacagcttgtctaaggcaaaacaagctaccctcca

SEQ ID NO: 9712 - DNA, 325 bp, artificial
  synthetic oligonucleotide
aatcctgctgcatgattccctgtattataatctggttttcattatgccgctagtcttagtgccacttattttcttacaatgggaggtaaagaactgggaataaatgtgtcaaaaactgcctaaaaatcatcaccctttgaatttaaaaaatagacatttacattttcaatttcccatgtttgcatatctcattatactgtacaatataattagtaatgttattttgaaaagctttatgcagtaattagcgaactactggaaagtttgaagttcctaggattatatacatctggattcagaggaaggaaataaaatctataaattt

SEQ ID NO: 9713 - DNA, 1106 bp, artificial
  synthetic oligonucleotide
cattctaggtattttctatatgtcatcaacaacacaaatttctccttctgccatgcctaatttgctgttaattccatccactgtgtttgtcacctcagacactatagttttcatctccataagatcatttggggtctattttatgatttccatgtctctacctattttttggacatatgaaatacagttgttgtaactattttgatgccctgtctgataattctgaaatgtgtgctagttctgggtcagatttgatttctcaaggtaattttcatttgatttttcttaacttagtgaggttaaacatcttttaatatggttaagactggttctatatcttttttgtaaattgtctgctcatgtcttttttcatatttttctataaggtttttggtattttatttcaacaatttttaaagtttttacatgttagtgatattaatgatctaggttataaattttctccagtttttcagttggcttttgaatttgttatggtggttttgttctgctttttaaaattttaagcagtgtgatgcatcttgggtgagtatacaaccagcagacaccagaaagtaagtgctgcaaaggaaatcatgggaagccccgctaaccccaaaggttgtatgctcaggggacttcaggcaggccgaatccgctagttgatcagaaatataagacctatggataacttcacaatctcttttccctttccttcagggccaaaaatttgagttggagaccctctaactagggagctacatggatataaattaatcacacagtgccccatccaagaaactggaagcttgttagagctattcataaaaatgaattctaccagtatatcaacttgcctcctgtgaggcaagatcccaggaaggtaggatgctaacagtgacagcaataaaataaggtgagaaaagcatctggcttgtgaggacacattttcagaagacctttgcacctaaaggtcacacacctctgctaaggcaagctcctccatgggaatactcatcagtcttaggtgggagttttctgcatgcaatctcccaacataacttctggcatatgaatatctgcctcatctctcctacgctgttaaa

SEQ ID NO: 9714 - DNA, 1033 bp, artificial
  synthetic oligonucleotide
aacctgtatatcaaatgcagtaaggtataaatgaaattgttaatatctgatatgatgaatttccattcattactcttgtttttcaaagttttcgatgcaatgtttttccatttttttctcaattaaatcttaggattactttattgagttcccaaaggagtactgctattattttgtttggaattcagctgaaattataagtaatttaaaagagaattaatcttcctttgccacatttagtcttccaactcagaaacatggtgttatcccctacttattcaagtcttttttaaatatatttctcagtaaagttttagagttctctgttgtaggtctcatatggttccaattaagattactcctaggcattttgaattgcattcagaaaacttctctggtatgaccgaaaatgaccatgcaacccactgataaatctaaaccagaatattggggctgatattttttaggccacgtggtctgatggcaattgaggccatatagtgtagtggttatgttcataggctttggtgtctagatagatgtgattctgaatcctggttgtcacttattaactatgtgaccttgggcaaattatgtaaactctgtttcagctgcttcctctagagaacagggatactaacagtacctctcctcataggggtttggtaaggaacttgcaggataatgaaagtgaaagcttagcatagtgcttcagacataataagtgctcaataaatgtgagctaagatggcagtgctgattaatggtgacaacagagaagaattggaaatagaactatcttgaaaattctgatagccaaaaatcacaggaaaatgaaaaggaaaaatacccaaaggaaagtgaagataaacagggagaggaaagttagaaaagaataggtgcttgtgttagggagttataagactctcttttctggtttgaagaatatggaaaaaggctgtatcattataggaagtagcaataagaactacgctagggaaactaccagaagccaaggagagggaaggggaag

SEQ ID NO: 9715 - DNA, 601 bp, artificial
  synthetic oligonucleotide
acctccaccctgctgacctcctctgtagaatctgatgagccattgctactgaatgaggaaaggcttaaccttcctttccccaccccatattcctttccctggcccctctttttcctccatagcttctgtctctgtttttattctttgtttcttgtccaccgcaaggtaaaattcagcctcttccttatgttccccatctcacccttgcccacatttgtgacatgtctgtggtcttccctttgtcatgtgaagaacggcagtgggatagagagcctagtgaagaggatgcacgcagtgccgggagtcagtcattcagacagggacataggtcttggaacttatacatttctcagctgtgtaaaatatgggtaataagagtacctaatccataggggcactgaaggattcaatgagtttgcagtgtacaacgtttagtacattctaaactgtatgccctgatatctagtggatatgcagtgaatgtttgtcaaatggctaaaattttgcatgatatgcagcccaaggcctggcacatagtgaatgctcaaagtaaaaatgttcttcacctgaactgaatcaaactctcttttcgatattagat

SEQ ID NO: 9716 - DNA, 634 bp, artificial
  synthetic oligonucleotide
cagaaatttattttctcacagttctggagaccagaaattcaagatcaaagagtctgcaggtttggtctctcttgaggcctctcttcttaaatttacagatggccaccttctctctgcatcttcacatggccttccctctgtgtgtgtctgtgtcctaatcttgttgttttatcaagacaccagtccttttggaatagggccccacccttaaggcttcatttaaccttaatcacctctttaaaatccctatatttaattatactcacatttggcattaaggtttcaacatatgaatttggggagaggtataattcagtccataacaggctgaagcccagttcctagagaatcaggataccaaaatcagagttgctgccaaagaccagagatgccagggaagagagaaattcatgtgccatgtactccattggttttcaaactcgtgtgtgtgtgtgtgtgtgtgtgtgtgtgtgtgtgtgtgtatgtgtctgaacccatttctcaaaagaaatcttccatcttctatggaagcctattatagcaagcatggaaacaggggttcactgttggaagctgaggtggaaggctggatggaccccaagcactcactggggacccacagaccatggaggtc

SEQ ID NO: 9717 - DNA, 152 bp, artificial
  synthetic oligonucleotide
ctcatggttttattcaaggaaagatatcataagtgtagtatacactgtgtagtagaaggttgattttccagacttattgagagaaatttcaattttcctctaattttgttcacatagacacagtgttagacattggccagtttagaaattct

SEQ ID NO: 9718 - DNA, 736 bp, artificial
  synthetic oligonucleotide
attagctctcatttcaggagcccttaaagctgggaagaagaggattccaaatgtgcaggaaactgggtctcttatagaagatctgagctacaagttgttcattttgcaaaatgtcagaatctaggagaagtgtgaccaccatgctccaataagttatttcatagacattcttaagctttttggagaacaccaccatttccaagaatttcctctgaatgaagaattagggctcatcttgagttattacaagtataactagcagcacatactcatcagaaatgccaagtcagggtgactgcctagatcctataattttaaactcacttgccattattagtttacatgccaacttttcccaaaaatgaatcaggtcagccacaaagttaaaataatgtcagcaaaaacaattcaaacaattcaagtaaatgattaaagatttataaaaaattatttagcgcaagaggaaagagacataccaggaacctcacatacaatcaccatccaaagttgagtacttaatttagcactggtaatctttttagcatgagatagatgtcatatcctccttgtatgagcacagactgacgtggaagaaaacaagagttcggaaagatttgtctaacaccctatagattcatactggtttcctgtgcttgatgagcactttaataattttatctcttcctctccttttccctcttcctttccactctgctgaattcatattctacattcc

SEQ ID NO: 9719 - DNA, 1481 bp, artificial
  synthetic oligonucleotide
gtggagggtggttaaataagtatgggaaattctgagttttaaaatttttcttctaagttgaattttgagcccttaatattacattgtgcacctctaagatgggggacatagtttattgttgtgtttccatagcttatttgaccctagaagctttttgcctatggaatatcagaatcaactttgagacatgctggaatgagtaaagttgagttgtgttggtgatttcgacgcatcagtgggttaaggaaagtcattgctgtgtaaggctacccctaactgagccagaagcaaaaatgtctttaggcaacatgtttctggcatatggagccgctgcagcaaaccctggaaggttcaccagcctatcaatggggccactaagctggacagtggtcctaagcagggagtctttaagccacagcctcattgcaagcaggtaaattgagctaaaaagttggagatttatggttcaactaattaggtgattatgaatactcatattggctaggtcagcatcgttagtaatgtctattcctctcttaaactttccccatggtagacatataaagtggggattttgagatcattacacaattttaacagctttattgagatataattcacatatcatacagttcactgatttatacaattcattggcttatatattcacagatttttgtaacaatcaccgcaatcaattttagaacatttctctcaccccccaagggagccctgtacccgttaagcagtcactcctcatttctccctccagtaagccttgaccagtaaactactttctgtctctatggattcacttattctggatatttcataaaaatggaatcatacagtatgtaaccttttgtgtctgtttctttcacttagtatgttctcaaagttcatccatgttttagcatgggttagaaccactagctgattctaactagggaatgttactaggaaaaaaagaatggtcttcccttttctacattctaaatgtatagggagaaggaatttgatggcattttaagaacattgagagatattgaaacaaaagtaaatgataacttgatacattctgatgcttaagataaaatgactctattatgtggatccttctcaaaagcattgaacatcttgtggattagtttttagtaagctggtgttaagtatgaatggtgttcttcaattctgtaaactattcgtcctacttgcaaaacaaggaggtggtgtggctattgtatcacatatctatggcttcccaattcatattcttacatctggcaatttcctattttatgaaatattttaatatggcaaactcattccaattacacagtcattataagttttgccaaggttgagtatggatcgttttgtgttcattagagcacaaaattagaattttcattgctgcaaccataaacaccattggcacaaaggatttgagcattttctcataaaatcttggacaactgata

SEQ ID NO: 9720 - DNA, 1522 bp, artificial
  synthetic oligonucleotide
cattatatgtaatagcacacaattggaagcacaccaaataataatagaacagtaattacatagtaggacactcaacagaatactttgcagcgattgaaatacaacaatgacagagactatgcagccgcacaaaatatatttattatatgatgttaaaataaaatcgagctgcagaataacatgcacactacaattatgatcatgaaaagtttgtatatgcatctgaaccaaactggaagggaaatgaaatcatagctgtaataagtcagtgagattatgggtgatttccctctctgcatattcttctttcttattttcttttaagaagacacatgctgtcttaaaaatatgaaagtaaggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaatatgaaagtaaaatacaaatttcattttatggtaaaagtgcaacgtgaatcattaagtaattttcttttaattattcacgaaaaagttatttagggaaaaaaacatgatttatgttttattatatgctattttacttcccatagaagtttatttcaatgaaatctgaaagtcaatggagaatttacgagcattcactttaaagtcagtgtttttaaactttattttgaggtaattgtagttgcacatgcagttgtaagaactaatacagagagttcctgtgtattcttcacccagtctcccccaatgggaacatcttgcttaactatattacagtatcacagcctgaacattgacattgaaacactccgaagacttcattcagatttcaccagttttgttttgtttccaacttcaccatttttgcatgtacccatttatgtcttctctatgttttactttttttatactttctgtaaattacatgtgtgtataatatttttttaatgagaggaatttcagttgggaataaaatgagttaaagcaactaggtcttctggtccacttaagcaattgaaactccactatcaagtcacttcaaatgtggttgcaattagagggtgagtgtaatgtgaacatagtttttagtagtgcaatatcatgttgaagaaatttttattactctctccccgacagtatgctggctacagagagagagccccattttcttcattcaagtaattatagttgctctgagctctgggaatctgcaatagaaatgtatttgtgaaaacaagtggggcatcacaatgacttgacatttcagtgatccaactgtcaaagaaagctagatttattacataa

SEQ ID NO: 9721 - DNA, 1016 bp, artificial
  synthetic oligonucleotide
attgtctggcaaccctagactcatacagtactcatgtccaaaaagagaggctgagaaagtcattgggctgacccagtagacacatattactgttttagacccgatgaggaagaatatgccttttgaggtgagcgaagtagattataaaaagcctgtcataagcaagaataacaatgactcccatcaacaaggcgatcgtggcagtcctgcagtcttcccttctcaatccaccatgcaaaactttctgaaaatgactttagccagagacttacaagcggatgtggggctgggggcatgaggattagttgaatagctttgggtggcagaaaagggatgcctttctggctggcccctatgtagatgatgacagctacttgagcatgtcctctcaagcaagatttcctcaaaatcatttcaaaaggagccttacactgtggggactttcacagacacttcagacactcagacacagacagcaacagtggacttggcatgtaagtctactgaatattttcaaggactggtgtttcttcctccacagaagaaagctttgtagcacgcgatgagtacatttatctaggactaacttatttatcagcaactaaaacatgaaattagccagtccttaaaggcgattttgtctttctctgcctgatgctttaataaatcatcccaatcaaggtcggcaggcattgggggaaggtaccacatttgcttttcatattctcacattctgcatgaacaatcattttccattcagggcctgtgatgacccccttgagaccgtctgcatgatcttatgatttctagtttctgggggactggccctgtatttgccttggcagactataacagaaaactttctttcctttttttggtttcaaaatgtaaaatcctgggaatgttttagaaacaggcctctgaccaagacaatgtttccactgtaatagaacataacagggaaggttctcatgagcagaatccttctccttctctagccatattttttttaaaga

SEQ ID NO: 9722 - DNA, 1254 bp, artificial
  synthetic oligonucleotide
ggaatttgggtgtgttgaaggcaattccaaataaaaaaaattactgtccaggacttaggcaattttcatttgagtagaatttgctttgtcatgtcattaacaggaaaaagatctacttagtcttgactttgcccagaggatgaagtgataaacacctggagaaaaattataattacagtttgtaaaagctaaacatagcccttctagtttttaattagagtatatgttatgtggctgagggtgactgatggatggaatttggtgccataggatcagagacccggagcagcatggtcctgtgtgtagccaaaagcaagtgactattagatgacatagcttgtgatgctaagccctgactatatatttatattttctgtataaacatgatagcctctcttctgttactctgaggaatctttgataattcacatgtgaaattaaaggcatcttattcattcagttatttattattctctgtaaaatgagttaggaatttgtccccgtgaataatgttagccataatagttaatttactcctattcattggcagtaataaaaatgtacaaggggaggcagaaacattattatttcttgcttgaagtgcaatttcatgtggtgagaaaaacatgttaatatgctgcaaagtgctacaggaatttagttctcaaaggaatggcggtattaaatgtattctgacaagaaggagcctcggaagggaaacatttatcttcataaagtcattaaatttactgagcagcatcacattcttcctgcaatctgctcactccattaaaggcgaagccgtggaactggctctgtcacatgagaggcccctgcatttctgaacagaggaagaatggtgctctttctcctaatattgggtttccccgtcaaaaccaacaagctcacgcacagatccacacatgggtgctctgctgcctctttccaaaacaaacaaatgaggtactgacaagattctgcctttctccacgatcagatgattctccgtgtgactaagaaaaaaacagattttgcaaagcctcctgtttcatcgttccaggagactcttggctccgagggtgttttcccatcccactgagttggagtccaggcagcttacacaggtcagggtcagcacgatagcatgagttgttctgcagagcagttttgtgtgtatgcatttcaaaatcgaggtattcttattcatacacaatacatcaatcagtgtttttgaaaatcacagcaaaagacagg

SEQ ID NO: 9723 - DNA, 1856 bp, artificial
  synthetic oligonucleotide
gagcttaatttcagctccattatttacaaggctatctctaggaccatgggcaattacttaactactctgtatctcagtgtcctcttccgtgcaaagggggatgttattagtatttacctaatagtgatgtcatgaggaataaataagttaatatttgtaaaatgcttagaacaatgccagaaatacagtaagcattatatacatgactgttaagcaaataaagtagaatgcttaattgatagaaagacattcatggtatattatgtgaaaaagcaggttgctcaataagtacacagcataatcccaattcttatattaaaaattaacagttattagaaataccatttgacccagccatcccattactgggtatatacccaaaggactatacatcatgctgctataaagacacatgcacacgtacgtttattgtggcattattcacaatagcaaagacttggaaccaacccaaatgtccaacaatgatagagtggattaagaaaatgtggcacatatacaccctggaatactatgcagccataaaaaatgatgagttcatgtcctttgtagggacatggatgaaattggaaatcatcattctcagtaaactatcacaagaacaaaaaaccaaacgccgcatattctcactcataggtgggaattgaacaatgagaacacatggacacgggaaggggaacatcacactctggggactgttgtggggtggggggaagggagagggatagcattaggagatatacctaatgctagatgatgagttaatgggtgcagcacagcagcatggcacatgtatacatatgtaactaacctgcacattgtgcacttgtaccctaaaccttaaagtataataataataaatttaaaaaaaaacacaataagaaatgaaactttcattttagctaatcctgtaatacctgctacagtaaaatgctctttgcagttttgtatgcatgtgtttccatttattgaaattactttatatataagcatatatgtaaatgtttacacttattttattaaaatcaaatctatcaggctggaaaaaaataaaaataaaaaaataaaaattaacagttattatagaaggttatatatataagaaatatgtgtatcaaatagttcaaagtatttatctctgactggggttgggtgatatgaataatttgtattttctcattttttcttgtctgcttttttcaaattattaactgaatatgtatcactattgtaatttttaaattattaaaatatcatattcaaacatgtataaacacctaaatatcactaaaaggggatgtgttggcagaaggggaagtgaccaattacaagcatgtcttaaactgttaaaaaattaatgttacgtagtaagtcacactgaaataatataaaagtcaggaaaattccttctcaaaaataattataatgaagacactgtagttattacttggaggcgaatattacattggaagaaaagcaatcactaagaagaaccacacctgagtactgggctcaattattccttgacaaaaggctactgaagactctcctgcttaagtggaaaaagcctaacactctttaaagaaacacagagttcctggtaacctgagagagaatatcaaatgattcaacatatatgtaattgggatcacagaaatagaagggaagaaataattagataaatagatagatctataaaagaaataatgtctgaaaattttccaaatttgatgaaaacaataaacaagaacctaaaatctcaaacaaaataaacacacaaaaatttacactaatacataccataatcaaattttaaaatttaatgatgaaaaaaatct

SEQ ID NO: 9724 - DNA, 2844 bp, artificial
  synthetic oligonucleotide
ccaaggtcaagggctgtccaaatgcatgacaatattgctgtagtataaccgttctaataccttgagtttagtctgaacagttcacatagtctgatcatatcctaaaaacaactcagtgagatagatagtactatcatgcccttttacacatgaggaaactaattaaggctcagagaggttcatgcgcttacccaaagccacacggccagtcagggttggagtcagaattcacactccaaattcagggcacattctcatatgccaccgtttctctcacgagctttcaaataaacattaaaaagtgatgaaatacatatttttcacacatttgtcaggacctattctaagtgttgagaatacagtggtaagtaagatgccacaaggtccttgctctctggacttgacattctagcagggaagtgtacaatgacccattaacaagaacagaactcaagttcagaaaacggtggatgctatgaaggaaatgaagcaaggtaatcagagggagatgtggcaggtctaaagacttgatggccagggaatgaggcagatggtgctttccacaacccagcatctttggaggaaatcctgctcccctggccgctgaaggtgataacctgtggggtgatcccacatctgcataccttctgccaggaagtgttccccaggcctggtcctcatcatcctggaagtggctgtcaagctacaggctgccctggtaccacataagtctgggattctctgcccctgaggatgtcaggaaatatatatgtgtatgaggttggaggtggaagatccttcaaagcctagtgtctacaaaaagaaggaaagtaaatgcataagatgtatattgctgctcacaatgaacacagctcctatgtccagaacagctggcttcttacaggactgtagagtatgacagctgggaaggatggcccctagatgggaagacccgagcccagaaaggagacttatccagggtcacccacatggcagggtcaggatcagggtcactttcaggtggatcacacccttctccacggctcatgaacaaggaaaaagaggagaaggcacacttatggaacagatgccagacactgctcaggcatcgtatgttctcaatacccgctcactgagggctcaaaaacccactcaagaggagcacctactttccccaatccactgaacaaacagacccagagaagggaagtggcttgcacaatgttgtccagctctcaagtggcagaacaggatcaatctggggccacgagggctcttcccttgctgttgctcttgagatcccccggcatttttttctgggcttcctgaattgccaagcagacccccaaaagggagccagagattggaggctcttcagttgctcttgtttatccaccaagccataaaatacaaatttccagggatgcaggtcaccaccgactcatggagagctccacctagagtggagagccttgtgaggagttgggggaggtgaacattaatatgttgggacctcgggaacttaaggagccccaggtccgaaatgcttgttgtgccacctatgatacaatgaaaatccccctctgctgccctccacttccttctctggctgcccagaatgaagtctactgctggcccagtagtctatgaagtctacctgcagacccaggttcactctgggacctggggtgatcacaccaggggcaaggcctacatcagcgcagtgtgtgtgtgctcgaccttccagaaccagggcatgatggcgcttggttgaactcaatagaactgaactctgcctttcagtgaagcttggactaatgctactcgaagctcgtgtgcctatgtaggtattagggtgaaggcaataaccaaaaagtgaaaaatggaacattacctccagttactgtacagatctcttcctctgagaccccttcccaacaggcaggtctaagagcctatttgttctctgtgagaacatgtgacacatattaccgcccacattggaatagaactctgtgctcagcttcagttctgaccacttcccagctctgagtgccctcagggcaccagggtacctccttgctacctcaccggagtcaccctttctgtgaagggaggccagattttacggataaaaacacaggactcccaattaaatttgaatttgagataaacaatgaataattatgtcgtataaatatgatccatgtactacgtgggacatacttatattaagcaattatttattgttcatctgaaattcatatttaactgggcatcctgcattttatccagcagctgtattcctgcggcccacgtggtggttggcacctgccgccaatactgcttgatagagaaaatagcataatattttgcaatagtatttggggatgaatactataggctgcaagggtaacatttgtgcatttgtgtcgtttttggaagacgtttccatcatgtataaagcctgtgcctcgtggattgcaaatgagacccagttccggggggggtgggaatgagaaagcagttagaaaagaaccccaggggatctgagacccgagcttcatctgccgagtattttattctcgttaattcataacagtgtctttaaaatcctggactagaatttgagaacagtcagtgtgtgcgacagtcattactccttggagactcccactccgccagccgggcgcccttcgtgcgttcttggtgccacagcggcctccagtggttctctgaggaaccacacgctgtctccaccgccaggctccagcttgtccctaaagccagggcggaaggcggcggcgccctgtggctgcccaggggcctgggctgtgtggccgg

SEQ ID NO: 9725 - DNA, 4301 bp, artificial
  synthetic oligonucleotide
ataacttggtttgaggaatctgtggagcatccagagaagatgtctaggggatgactggtcatatacatctagatgcttagagctggagataagggtgtgagagccatcagggagtacagaaatgctcattgaaaccataggactggatgcaggtgctcagggagaatgagagcagtggaaagccccagaagagtgtgaagacagggagtaacacgattgtatgttcaatttagaatggtcatgtcatgaaacatggacaatggattgcaaggagagagaccactgacaggctaccagtcaggagtttattgtaggccagaaatgaggggatggcctggactactgcagaggcaggaggcctggaaagcaagagacagataccagacatggagaagcagaatggacagtactcagtgactgcttggctgtgagaaatgagggagacggaaaggtcaaggatgacttgggtaacaggccagataaggggccattaactgagatgatgagcagtgaatgtggtacaggtctcagggaggcttgctaagtgagaggtgcctgtggaatctcctggaggacatgtccagtagccaactcccagtgccaaggagaggaagtagatggtaggtagagggcagtctgtcagcaccatcatcagtcctcaggtgaggaccagtaaagtgctacaaagagaaaggactgccccataacagatgttggcagcattcagcccgtgggccagagaatctctccagtgactcagaaagttccaccatttaaaaaaccccagttctcctcataaggaggtgatattggtgggatgcatatattcattcctgggcaaaggccaagtgaattggcaagtgatatggttgggctgtgtccccgcccaaatgtgctgctgtaaagatacccaaaaatgtggaagcgattttggaactgggtaaaaggcagaggttggaacagttcagagggctcaaaataggacatgaaaatgtgggaaagtttggaatttcctagagacttgttgaatggctttgaccaaaatgctgatagtgatatggacaatgaagtccaggttgaggtggtctctgatggagatgagaaactcgctgggaaccggagtacaagtcaatcttgctatgtaaagagactggcagcattttatccctgccctagatgtctgtggaacttttaacttgagagagatgatttaggatatctggcggaagaaatttctaaggggcaaagtgtacaagaggaagcagagcataaacgttcgaaaaatttgcagcctgaccatgcagtaaaaaagaaaaactcattttctgggggagaaattcaagccagctgcagaaatgtgcataagtaacaaggagccaaatgctaacagccaagacaatgggaaaaatgtctccagggcatgtcagagactttagtggcagccactctcatcacaggccctaaggcctaggagggaaaaattatttcctgggccaggtccagggaccccctgctgtgtgcagcctctggccttggtgccctgcatcccagccactctagccatggttgaaagggaccaaggtacaactccagctgtggcttcaggaggtgcaagccccaagccttggcagcttccacatggtgttgagcctgcaggtgcacagaagtcaagaattgaggtttgggaacctccatttagatttcaggggatgtatagaaatacctggatgcccaggcaaaagtttgctgcaggggcagagccctcatggagaacctccactagggcagtatggaatggaaatgtggggtcagagcccccatacagagtctttactggggcatggcctagtggagctgtgagaagagggccaccatattctagaccccacaatggtagctccactgacagcttgcaccatgcacctggaaaagccgcagacaatgccagcccgtgaaagcagctgggaggggggctataccctgcaaagccacaggggcagagctgcccaagaccatgggaacccacctcttcatcagtgtgacctggatgtgagacatggagtcaaaggagataattttggagctttaagatttatttactgcctcattggaatttgaacttgcatggggccagtagccccttagttttggccaatttctcccatggaatgcctgaatttacccaatgcctatatccccattgtttctaggaggtaactagcttgcttttgattttacaggctcataggcggaagggacctgcattgccttagatgagactttggactgtggacctttgagttgatgctaaaatgagttaagactttggagaactgttgggaaggcatgattggttttgaaatgtgaagacatgagatttgggaggggccaggggtggaataatacggtttggctctgtccccatctgaatctcaccctgaattgtaataatccccacatatcaagggtggggacaggtggagataattgaatcacaggggtgagcagtttccctcatactgttcttgtggtagggaataagtctcacaagatctgatggttatataaacaggagttcccctgcacaagctctcttgcctgccaccatgtaagacgtgactttgctcctcatttgccttccgccatgattgtgaggcctccctagccatgtggaactgtgagtccattaaacctctttcctttataaattacccagtcttgggtatgtctttattagcagcatgacaacagactggaacagtgggtgagttaccaaaaattcggctgtgaggtccacagtgttctgctttaggtgatgtggggaaaggccaaggaaactgaacatttgactcccgcacccctccagaggtatgatccagtatgatcagagacaattgttccaaacatcaagtgtgttctgaggcctccattgttgaggcggcttgtgtttgctccccagaatattcatattttaaatattggaacaagcagcaagtgtcacaaaagtttggctggcaagagagtgatgcaatttgccacctacaaatgtgggcaagcttaagaaatgacagcaagaggtgttgggggcacccagtgaggagctggggagaagggaagaaggtgctcccatgttttctaagcacttccctggccattggctcttttttcctttctttcctttttttttttttttttttttttttttttttttgagatgggggtcttgctatgttgcctgagctggtctcaaattcttggacagaagtggtcctcccacctcagccacccgagtagctggaattacaagcgtttaccaccacatctggctgccaatggctttttctttttagatggagtttcactctgttgcccatgctagagtgtagtggtgcaatctcagcccactacaacctccgcctcccggcttaaagagattctcctgcctcagcctcctgaggagctgggattacaggcatacaccaccacacctggctaatttttgtattattagtagagactaggtttcaccatgttggctgggctggtttcgaattcctgacctcgagtgatccacccgcctcagcctcccaaagagctggaattacagtcttgagccactacgcctggccatgctattggctcttgacatcccaatgcctttgaggcaggcagagcaaatactatattcatcttttgacagctggagaaactcaggcccagagtaggaaatatgagggattacccaatgaattcagttccagtaaaactgttcctggacccagaactcctgcctcccagtttggtagaggttccatttcatcatttggccctaggcagtggtatgctggagctggtccatactggttctcaaagatgttcattaaattttcagaaattctggagactgttgacagaatgttggtagtttgaaatcagtcatgatgtgactatttacaccatggaaattggcaaatgctaccaatataccagcagtcccaagtcattgcagacccatcttccattgccaaaggctgtgtccactgcccgggcctgtgagttatggtttggtagctgcatgggaaagtggctaccagaggaattagatgataaagggatttgagggtcagcactctggcttgagtcttacagagtgtttctagcacttgttccagagacacccaactggccatgctaatttactgctgttgccaataacccaaagagaatttccactttttccattaaaacaccaagttttaaattatgagttagagcaaagggggactcattggcatggtgtc

SEQ ID NO: 9726 - DNA, 1517 bp, artificial
  synthetic oligonucleotide
aactcacttcactcacacaatgccatgtgagggctatgctgttttgattcccattttacagatagggaaatggaggcacacagaaggtgagggggcaaacccagcattcatacccaaggcggagcattgcagagccgctatggctgtcagccatgtattcagatgggcaataagcacatgaaaagatgttctagcagagcaatacaaacgaaaactaccgtgacataccatgtcacagccctcaaattggaaaaaagaataataatcgtatgctcccaagttctagtgagaatgcagaacaatgggaactgccaggtatcaccagcaggagcctctctgcaggcaatttggcagcatctggtgaggttgaaaagaccatattctacttctcagcagttccacccctaggaaaattccttagagaaacactcgcatatgtgcttgaggagatgtgtacaaggatactcagtacagcattgaacacactaccgaggagccctggaaatcactgattacccatcagcctgggaaggggtggagaaactggtttattccttcaatgcaacttaacaaggatgaaattcagaaaacatgttgggtcaaaatgtcaattgataaataccagatggtaccagtgatgtaaactttgataaaacacaaagtaatactgtattttgttgctggatactcacaggaaaagtgtcacaaatctgcacaaaaaggaaggtcacatggcaacttgagaagagttgtccctcagagtgaaagaggacagtgggtctgggacgggcaacacgggagactggagctgtgtctcggctgacacattttcaaagatagtgacacgtgtgaggaaatgtgtacattaggtatttcttggtgaacaaatacttagtacttgggtgtttagtactctgtgttgtactttcctgtatgtgtcaatgaggcagtagttaaggaaagtatgtattatggtaaactttgagtaaagggcttatttacaaatcagcagtcacagcagatgggtggaacacgtgagttctcatgacgtgcgtggcataaagtgtaactcaagtctctggttctctccagcagccgaatccagtggagcagcgttacatggagctcttagccttacgcgacgaatacataaagcggcttgaggaactgcagctcgccaactctgccaagctttctgatcccccaacttcaccttccagtccttcgcaaatgatgccccatgtgcaaactcacttctgaggggggaccctggcaccgcattagagctcgaaataaaggcgatagctgactttcatttggggcatttgtaaaaagtagattaaaatatttgcctccatgtagaacttgaactaacataatcttaaactcttgaatatgtgccttctagaatacatattacaagaaaactacagggtccacacggcaatcagaagaaaggagctgagatgaggttttggaaaaccctgacacctttaaaaagcagtttttgaaagaca

SEQ ID NO: 9727 - DNA, 1541 bp, artificial
  synthetic oligonucleotide
gcggctcggagggccgggggcgccgctgcgggccctggagcggccgagcgtcatggctgcacgggcgcctttgttatcccgaggagtgcgccccgcgccggggggcggggaggtccggcccgggcccccgagcccccgggcggcccgggcggggcggggcggggcggggtgggggccgacgggcgggcggcggcggcggggcccgggccgctttgttcgccgctgtcgccgccgcccgcgccggccgcgcgcggatcagccattttagcgagtgggactccgaggcgcggcggacgccgccaccagtgccgcggctgccgccggcccggccgcacaccccccgcgcaccgccaccgccgccgcccccggccccgcgcgtcccccggggatgacagcggcggatttcaggggcactttctttcatcaggaggcttttgacaaaatggaaggtgaattacgggtgtcccggtgacccggcacgggggccgaggcgggctgcctgctgccggccgggactcccccgctcccggtcccgccccgcccgggccgccgctgcgggtctctgttgggcagcctcctgggcggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtgttcagcagtggtaagagttgttgtttttaattgtgttaacagttagcagatgaccagatagtcttaagtcatagatttcaagcttctatcacccccaccaaatgtgtcctctctctacccttcccactttgtgattgtagtttccaaaacatagcagttctgtaaacgtaacactgagtaccctacttgggtcggctccatttggagcacttgatcgcttttgagaagtaactcgcaaaccagcgcgcttcgtgctggtcaaaagttaaatgacaagcgacaatgaagctgatttctttcctactctgccttctgccactggtgtccggcattgggggaaggggacttcctaacagcaagtgtagttttagttttgctctgcctttggtacgtcttgtacttcttgtcaattcctccttgcttttcctcattgtatttctttgtttctcttttatcacagtcaggatggctaaaggtgaccccaagaaaccaaagggcaagatgtccgcttatgccttctttgtgcagacatgcagagaagaacataagaagaaaaacccagaggtccctgtcaattttgcgg

SEQ ID NO: 9728 - DNA, 7213 bp, artificial
  synthetic oligonucleotide
atccagcctggatttaagccttggcatgaccttggacaagttctttcacctctctggggcctcagttttcttatctatttaatgacattgtgagaaaacattttcccaatgaacttttgaaaactataatatgcttatttaaaactgtactcactagttacaagcaaggcattattatagtgctggagggttaaacagagagcttagaacgtttgataaaaggtaaccttccatcattgccgatgtaaatcagggaactgaagatgcaggcagtaccctcatgtgctcagaaggattacccattcctgagcagaaactgctcacttgccctctcattcctctgggaatattccaggtttcctctatttggattggatatcttaatagctttaaaatctcaaataaagggtttatgtccactccagttatttagggcttcctaacaagccttttagaaagagacttaattaaaaatccagtggaatcttaaaccatgcacattacactctatccaataaaggactcccccttaactcttccaaagcaattgaacttactgcacgagacttgttttgcctttgcaaacagggaccgattttctccctcatatgtatccttataactgattcaatatctgattttcttttttctttttttttttgagacggggtcttgctttgtcgcccaggctggagtgcagtggcgggatctcggctcactataagctccacctcccgggttcacgccattctcctgcttcagcctccctagtagctgggactacaggcgcccgccaccacgcccggctaatttttttgtcaatatctgattttcttagtactggggccatgttcagaatctttattaagacgagttcataaaaataagaaaattattttaaccggatacataattctgtccccctagatcattaaaatattcaccttttccacttgtctagtattgaaaaaccaagtcccaccaggtcacagtcaagtagtgtccaagcaggggtaggggccagggagtcagctcacccttgctctcctgcctgctcctcaatcccagggatgttcaggccacatccgcggggaattcccgggggctctagccacctcatctcagaagtgcagtacactggagtgtagcaatgcctgcaaggtttgcaagctctccttacaggtttgtttggggcagggggagtctagtgtcttaagtcactagaaggtgtgtttcgttttttccttcaaatgtattttgtttacttatttgaattcaaaatcgccccttcccacaagtgaagggatccaaactctcggggaaccagcaagaacagcctgatgtgcatcctacaaaatactccactgcgcggacgggcttttgactgacagcctctttacagggcgcacagctgtgtggggaggacagcggagccccttcactgtctgcacttacggaaaaaaatgcgagcgcgcgcggccgggagttccagccagcgaggggcagtgagataatgaatgtgaaaagcctccaggcgggagattgtaattcgcgccggattcagttcacagacgcgaaagccgcaggattggggtgggggcttcattttcaaacaaggagacacatttccagtttaggctttatagctagagacagtgtgtgcaatcttggttttcaacagtgtctgtttttttcgttaaaggtatctgaatgttgaagttcgtcgcgtaacaggcccctactacctaccccgccttgtccgtccccccacccaccccggggcaagagggctgctgtgtccagacgatggcgctcccggccagtgcaacccctctcccctactgtggcaagaagactagtctggaacaagtttcaaggtgtttactgagattttgaaaggcttctcgacaggagccgtaacttttagtagccggcagaaatccattcccgtgaccaaggttattgagggaacgagtgtccgaatcacgcccctttagttttgcccgaatattcgaattttccgtggtccccgcggagcgagatcctgggcgcaccgcaggggaactgtgacgcacggggacagagatccgcggtgtggagggcgaggggggaggcctgagagggatggggtcgaaacgagaaccccagaagggcatgggaaaggagaaagaccgagaggaatcctgactgaggcagggatcgccggtcagccagaggcttcttggtttagccgcgtgacacctccgcacctttcccgcggctgcggcgcagctccttcagccttcctgactgccccgtgccgctcagtagagaatgccgagcatcccgagagggagaggcgtcagagcctctcgtcctgagtttccttgagaagcggggacccaagagaagagctttattgcctgttttactttttcccaaagcgtcccttggcttccgccgcctggctgccggcagctggaaaggagacgagctcccgctcccgttcgcccccaaactgaggaccgagtggccaccaatgccttccctaggtcccagggtgcagacccgctccccacttccagagtcgggcgcagggtacatctctttatggagagtgcaagacctggaccggactgagcggctactcgcagctgccgctaagggagccaagaggctcctggcgagaaagggagcggggttaagttccctagggattagggacccagattgggggtgggagctcccagcagtagtcccctgttccccgcgggacacagaaggctctagacaggcaagggcatggggcgtgggatggacctcacaaggatacttgcagaggcaagcatctagcgttcaaggggccaccggctatcccctataccctgctgggggctgtggactggcttggtctagcactggatcctatgaaagactctgtgctccggctctgcaatctacatctctttgccaggtgtttgcactggaggagagagggagaagaacttgctagaaacgaatgcacaggggctggtggagggggtgtggggtggactccgagctagtcatgatgcttgcaaggtacctgggagattgagaggcagggcaggctggctagagaggaagtacatacaaggcagtcggaagcaagatgacacctcaatgtggatttgtccaataagagggggtagccaaggggggggtattcagggaggtctgattggtcggggggagggatttggggtggggctagccgcctcttgaggctttaaaagctcatcggagaggggcgggatgctgtcatttgctctctgactctcagagagggaggcacgctttcctggagctcctggtgacagaacaggtgtttgctgtctggacctggctgctgatcctgagcctgctgggagatcttaacgatccccaggagcaacatggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggtaagccaccccttcttctccctacccagtgtgcagagacttgcaacccctagggcgttagtttttgagctccccgaatagagaatctatggacagtgccctcatattgaacatccctgctcccaaattccccgcaagcctgggggtggtagtattctgtcccggccctctaaacgtggaggttctcaaggccgagagagcacagagaattagctttgggcatccaagtacaaagcgttcccgtggtgcgcggcagcccgaggatccctgtcccgtcggggcctgatgcggagggagccggcacccgagcgggagagtcaggcgattcgcccggggacagcaagccgagccggacgccgcaagggcggccgcgctgaggcagcgcggaccgaactgacgcggagggagcagcggggctgcgacctgctctgtgaaagttaagttcgcggcggccgcggcggcccttaccagagcgcaacgcagtggcctctccctagccgggccaagagcccgctcgccgcggccctggggctccaggacggctcccgggcagatcccgggcggcggagcacagacccccgcgcccgagaatcgagcagggaggtctgagcccgccggagccgagctccgtccgcccgtcccagggcgaacggcagagagaggcaagcggcgggtcgggcacagcaggcggtggcagcgacggcggcggcagcggagatcccaaggtccgtaagcggggaactggggggtcgcagggcgggccggccaagaggcttgggagctgggcgttgctgggggtggagggatagaaggcagcaaaaccgagtagggattggcgggagggcgacgggagagctcagaggcggcgatgggggactcagagaggctgcaaagggctggggtctgggagccgcaggcgggacttcccccgctgctagccactgccgagcgggaggaggccgggggccgggggccggcggcgagcagggcaggagggaagcgtgggaggatgccgggcgctgcgacctgtgctgggggtgggggcggcagacactgcagagcagctagtccggcttacaggttgggcgggagagggctctggaagggaggggaaggggcaaaggcgcccaaactccgagttcaggccgggggagggaggggcggcgcctggaatttccaccgccagattctcgatcggctggggctaggagtggggaccgaagggggtctgagagggtggggagaccagctggattctcccgggcagggcgtgggggagaggtggcggccggggtctgggggattactttgcttgggcaaggagtcacgaacactgaacaagtttaaaaacgcactgactggcacacagtcattaaaagttttcttacaaagtctggtgggtgtctccgatttctccttcgtctcctggaatcgtggggccatacactaggtcttcaccttcacccccgcggtgcggtcccgaggtgcaaacccacggaatcctgggggcgacctgcgaagcccattttattccctttagatttcttttctttctttttctccttctccttccttccttctataattcaaataaaggcttttatggttgttgtggttttgtttttaaggctttgccccttctcttttcggctgtatttccctgaattcattactctgccggaaaaccatagaaagaacctcttcggtagaaagtgctgaggccgagtgctgacagcgctggaggaaggaggaagaaggagccatacctttgcccttttcaaaagcgctcattttctcctagtccaagatgaagtgcaatattttgccaaaccaatgctaattagcaacgaggtgtctccaaagaaagagggctctgcgcctgcacctggcctcttccttctcttttttgtgaaaggttttacaaaaaagttcccacctcagccctacaagaccggagtgggggtgacccttcttctctatcctgtttaacctgaaggctccagtaaagttcagtgcccggcgctgggagctctgtgcagggcgctgaatgtgccagtgcgcggctctgcgcgtggacgtggacgcggcatgtaactgaaacaggcacttctgctaatccttgcaggattttttctcctcccccccacccccgcccacctcgcgccacccttcccgcccgccctctcactacttctttggtctcagactaaattttacagggcttccctgcttcccctcagttttcactcttaggttacctcggaacggtaagtatttgacttggcaaggttttaggttactgcttgatcccatcggaaaagactgtttaagaagatggcctctaatgccttttctcagaatcttctctctagtaatgtgtttattataaatgcaatgctaggctataggagggagatggctaatttatctttttctaattatttaattatttttaatttttttagtttgaggcttcctgacatccctccagtgtctctccttgccccccactctccagcctccttcctaaaaacaagtccctctagctcacctctactcccctcctccttctccctccccctcacctccagtgaaggaaacgtttgcattttgtttttctctaagatggtggcagcatgaccctgtctcattgtgaaggctcctggcagggattttgtgctcactgctgtctgtcttatgttcgcttctttctcagagcatttctttaaaagaattctggaattataaaaggtcataatccagctggccttcccctgcaccttaaatgtgtagatttctgtacttaaaccacttattcttctctgtctttcccctttctccctccctcgatatgtttttcaggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgcatctacctggtcatcacctggatcatgaccgtcctggctgtcctgcccaacatgtacattggcaccatcgagtacgatcctcgcacctacacctgcatcttcaactatctgaacaaccctgtcttcactgttaccatcgtctgcatccacttcgtcctccctctcctcatcgtgggtttctgctacgtgaggatctggaccaaagtgctggcggcccgtgaccctgcagggcagaatcctgacaaccaacttgctgaggttcgcaattttctaaccatgtttgtgatcttcctcctctttgcagtgtgctggtgccctatcaacgtgctcactgtcttggtggctgtcagtccgaaggagatggcaggcaagatccccaactggctttatcttgcagcctacttcatagcctacttcaacagctgcctcaacgctgtgatctacgggctcctcaatgagaatttccgaagagaatactggaccatcttccatgctatgcg

SEQ ID NO: 9729 - DNA, 2334 bp, artificial
  synthetic oligonucleotide
gtcaaatggaatgcatctgattaatttctcagcaggtagacgggcctcagccatcatgttagctttgaaggaaggactcaggccatgggggaaggcctgacaagagcagggcatggcttctgtcttaggaaccgggctgcatttcaagacaagcccatggccctggacacgagattcagttgtaatgactgggacatgaagggagtcttgctctccactggtagcggacctgagtcttgggtataaggtaggaggaagcaaggaggacttggtgtcacagtcttgttgccgctggctcctgcctcaggacacaggggttctgttgcctggtgtgtgcccaggtgggcccagctcttgctgaggctgccagttaggcacctacccctgttgttagtttcctagggctgctgtaacaaaatatcagaaactttgtggcttaaaacaacagaactttactccttcaccattctagaagtttgaaatctgaaatcaagatgttggcagggccacattccctctgaaggctctaggggataatccttcctcgcctcttccagcttctggtgactccaagcattcttttcttgtggccacgtcactccaatctctgcctccatctttacatggccttttctccactgtctgtgtcttctcctcttccgtctcttatgaggacactctaaatccaggatgatctccacatttcaagatcctttgtttaattatatctgcaaagaccgcttttccgaataagattgcaatcacaggttccaggtgaacatatcttttggagggacactacttgagccacttcaccctgaattttgagtttcctattcgttccacatcgctctgtgtggagactacttgtattggcactgttggtgtggctgcccagctcctttcagagtgttcagaagcctgatggatatccagtgctactgctcagtgggccaaaatgtggacaggtcaaggcccagacattgaaggcatagttctgacactctcatcatgctacagctggggtgtttgccataattgctactaatcatagtgaaagcttttaaaaatggttttacaatcttcttctggaaaatttttttctccattcataataaaatgagtgttttaatgaacaagagggcattcagctccacacctccatttctgttaattttaatttttttttcttttttttgagatggagtttcgctcttgtcgcccaggctggagtgcaatggcgcgatctcggctcactgcaacctctgtctcccgggttcaagtgattctcctgcctcagcctcccaagtaactgggattacaggtgcctgccactatgcccagctatttttttttttgtatttttagtagagatggggtggcactgtgctgcccaggctggtcttgaactcctaacctcaggtgatctgctcacctcggcctcccaaagtgctgtgattaaggcgtgagccaccatgcctggctttgtgttccttctaaattagcaggtacatacagggaaaagaggtttggcttggacatcaacagatatgggttctcatctcagctcaggcactaccaaggtgtgtgaccaaagcatatgtactttccctctccgggctcgatattcttcaattgtgaaataaaggattaggaaatgtgttctctgaggacccttccacaattgagcctctttacttttccgttggtggtgcttctggagaaactgctttgcgccggtcaaagccaagttgaattaagacaacgatgtgaatttccatgtctcctacaccaggaattgctgacctcactccacttccctactctagcccccagatgtagtaacattcatttgggataattattctctccagtaggcctgccttgactcacgtctcagccccaggactccaatggccttgtttcctaagagacctgaacccaatggccagacctctcttccaagagaggaggggagactgaggccagaagaaccatgtgcatgactgcagtggctctccccatacacccagacacacacaacatggtttctcaggtgccaacacctggagctagtttataattatttctcaagttctctgagtttgactcacctcttttcaaataaatggatgttttcctgtggctcagttattattctttccatattgaagttagtaatatatgctcactgaagagggaaacaagatttagttttacaaattcctacaaattacgtcgactaacacagatgaaacaaaatcactaacacagatgaaactaacacagatgaaacaaaattctgtcaatattttcgatataagaaaaccacaa

SEQ ID NO: 9730 - DNA, 1674 bp, artificial
  synthetic oligonucleotide
tgcagagaggtcaaacacttgctggagataatagagcctactatgtagtaccaccaagaggtgcagcaggcactacgctccagaggcactgctattcctcctcccccaccttgctatccaccgaggcccccatgttcatagtctctgcagatagtcctgagagtggaatggcggactggggtgcaggaaggatcctgcaagacctcacagtagagatgtcatgcgcactgtgtgggaagaatgaatgcaagtgctccaggtccacagtgggaggaaaggcattctgggcagtgggaagtagaagtagcctcatgtggctggagccagaagctaaagtgggagtgccagaaggagggcagaagccatagacccttgtgcacatactggaagagctgcttttttaacagtcaagtgcacaagggtctatgcggtgttaagatcacgatgggaacatgctggtgggctaggaaactcaagaggttagttccagaagagtctgtggaattctgccccacaggctccggaggcatggggggaaggccatagaagagctgtcgtgggtaaggaagattcctgcagccgtgaaatagcaagcaagctagggaagaactctaacaggaggcagaaatggaagggaaagcaccatgcggggagagaagtgtagaggcaggcatcgggggagctaggggagccaggccctgggggttggaggggaggcggccggtggcaatgaaggccttcgcccacccctcttccgccccctggcaaggcaggttgctaatacccgccctgggataggggtgggagtggttctggaaccgccttctgagactcattcccatcaaaagcaacacttggggtggagggaggaagaggacgccaaccccagtgcctggccgggttctagatgtgcagagaacaaaaaggaaccctaaaaacccagcatccccttctccgagggaggctttcctagacccagaacctcagcccacccggaacccctttgcccctctcttagcagtggacctgtcatgtggttcctcctggactagtgtaatctctgctatgcgtcttgtcctgccatgctgaacttctcacagtgcggcctccgaaggagcccccatctagcgctccttgcagtcgcagaagattccttctccccttactgagccttagagttttccaaacccatttcctccttcaaatcgctgcagcctcgcgagggaggcagaattctccccatttctcggactttgcaggagagaagcctgccttcccggggcagggtgggggtaggtaagtgaagaagccaaggtcacccagtcattggcggaacgcggcctcgactcggtccttcttctgagggccctgtggatccctggcaaggcaggcctaggttgcaggctagcccccctctcttttcgttggccccaggagcccggcgggcctgaatggcaggtgagcccggggggtggggacaggacgcgggttgggctgcgcagggacgcctggcgcgcgggccttgggagcggccgccggagctccctgctacgccgtatcttccgagggcccacgccttgggtcacgactggaccagggctttgaccaagggtcctctgtgtgccccaggcccgccagtcaggccccgccccccggcggcacgggcgggggcag

SEQ ID NO: 9731 - DNA, 621 bp, artificial
  synthetic oligonucleotide
aaacaaagcatgcattgatttagcaaagacctggcctgggccaaaggggtcacttgttgtccccaaagtgtaattctcaaagcagagacccaacttccgtgactacactcgatgggctgtacttttgagtgggtctgactacagagtaacagctgcacaaaagctcccagagcaggctaaggaaaggtggtgctaagggaaatggggcatttaaaattaaaggaatggaatgtaccacagtgattgctgaggtcttgtcccccttgaaagttctataattcagatgcctagtaggactgagctgcttgaagccaggcagttttctctcatggccgcaaacactgccattcattgcagcaacactttcttagcatcttctaactgcaggttcctgtgctgagccctgggagagggagatcagcaaagagtcacacatggtcccaactctggagatgcatggaactcacagtccagtgaggaacaagaaggaaaaaattcctaataggacaaaatcgctgaagcattgaccaggctggattgttagctacatgagcacagggattattatatggcttgtttactatggtatactcagtgcctggtacccactcaatatttgtt

SEQ ID NO: 9732 - DNA, 1250 bp, artificial
  synthetic oligonucleotide
ccagggacctgggacacagtttggcctggattctgattcctcccagctttctttacctctacccttgaatgtgctgggggaactctcaaaccttctgtctgacctcctgagacatggaagcctgactgttcacatgctctgaataagtaaatcccatgtcagaatctcaatttttcatctagaaaatgtggggccttgactggctggaatctgaggattcctcctgccctgcttccaccagcagtagttggaactgagactgtgcctgtggcctccacatttgaggaggccctggcttctggccgtcccatggaatgaggcattggcaagtttccaaggacaggttgggacttttgtccttggccaggccagggggccaattaacagtaggttaatcacagttcaacatgcccaatatacttatttactgagtcattattaaataaggccaattaatagcgttggatggatttttaatccctgtgaggcaccgatgatgtgaaggtgacaatgtgcaattaacaaggcaataggtgattaatggcagtgaccttacatggagaagaaagcccttcctccagccccctttattccatacacaaataaagcattttgggaaagtcagaactggtgataggcagtatgccaagataaagaaatattttgcaaacctcattgcaactgatgcagcgttggaaaacactgtcttttgtgatttttgtggcattactagaattagagcatccagacaaaggaataagcaggtcttccccttgtgtgggcagcaattgcactcctcaggcctctctctcagggaggcccaggggatggatagtcctggccctgtgctgtgggtatctaggggaatccaaaatgcagggatgagcatcatttaaaagaggtctctatcaatctgagctctttagcagagggggcttctgaggaaagcattaataatatccatagtgtggacataatgcaccccaaagaagtttgcaacctaaattctcaaggtccttcaaccttgagagtgctgaagttcatgttttgaaaagtgcagtcttctgtgaatgaaagtcagggtgggaaatggcctggactatgacccagggggaagagaataagagcttgagtcagatacttctccatcttagtcctggccgctcatcagctgaaaaaccacgatctggcctcttagcctctttgagcccacctcatctcattagcaaacagctgtgataataacccct

SEQ ID NO: 9733 - DNA, 3485 bp, artificial
  synthetic oligonucleotide
gcccctgccatagactctctgaatcacaattcgcattttaacaagattcccaggagatatttttacacattaaagtttgagaagcactggcctaacgatttccgaagcctctcataactctgaaatcttataatttacttcagatagagaatttcagagttgaaagaccctcagagacacagtccatctcaacatcttacagatggaaaaactgaggcacatggaggggaagtcatatgtccaagataatcagcaaatcatctgagctaggaatggaacccaaatttgctaacagccaagtcagtgttccattctagcaaccacatactcacccctttccacccagtcccactgcattgtatcccctcagtgatgtaattattcctgaggtgttttctgataaaacaatatattcttctaccttctgcatactgtatgaaccttgaactaccactatttcaaatgtggtacttttcttcatgaaattagaaaatttcataattttctttatgaaaattcctgccactcaaatcttcccacacgcctattgtccggatgccatatagacatcctgggggctttagaaggactagtactaaccaatttctggtctttaggaatatgaaagcgaccttccttgctcccatcagtccagttgacaccagatagcaagctcatccaaggaagagaatatacactatcagggctgctctagaaaactccgtagggtcaatttgtggctaacaaaacaagtgggctattaggccatattaagaatagtctaatatccagcatgaagtaaatgataatcctttactctgtggtcttattggatccaagggttaagagggaggcatgattgctgtcttcaactaactgaagaactattattaagaaaaagcaaatttgttccagatagtcccaaagaaccaacgaatataagttactgggaaacagactttggcttatgatggggaatactttctgacaatcagagttgctccatgacacaaagagccacctaatgcactctctgtcactgcagggagttcaactagaaatcagtcaacaaattggatgcttaggataaattcaagaactgagtagagaaataaagcttaatgaatgaccttttgggctccttccagttccaaggttttagtattctaaaattttcggcacagaacaactccaaatgctcaggaaataagaatgaggtctgtttttaaaaggtgcagtttggagcatgttgggtggatgaggctataaaaagtgaagtacgattttcaaggaaaggaagctgaccaatcaaagtcttttgggcagcccctccagaaatccaggtgaagcccggctccaggctgagttgctgttactctacacgaaagccaggccgctactttccaaaaaaccttgccaagccacactgtacctattgtatctacacttgcctaacagacaaaggtgcaaaattctccccaagaaggcagtagtgcttcatggttaagaccacggattctggaaccaggttgccagtttaatttccaactgagacatgtaattgctctgtaatcttggataagttacttaacctctctgtgcctcaattttgtgagtaaaccaaagataataatagtgtctgttattcaatgcactattctgctacagtaatttaatgaagtaatacacaccaaacactcagcccagaatccaaaatatactacatactcgataattttagcaattagtattagggatgtcagaattactaccacaggcacagcagcgtcactcacttagaaagctcccatcaaacaattggatcccttcccctaccagttctgaagggctatactacaagagcctcaatcagtctttgcagagctccagacaaccagaacttgctgactctcaataagccaaactactcacgttagtaatcctacctcatcaccctgctttccataaatccaacagccacccttcccccagtcctcttgcccatgccacccgcagccacagccacagccacagtcagaggagcaacaaactgggaggccagttgcagacaaaccatcaggtgtttcctcccttccaaggacacagctggacttaacatgatgcctatgagtgagatggggtggggtatctcaatctctgatctaggatgtcagctcaattatctggaattgagggtgggcaggcaatggagcttctcgccgggaaacaaggcaaacctcccaagtttgtggaggaagtcaggcccaaccccacagtgagcccctcaaaggaaggggggagggctcaatctgctttaaaggaagcagttatttacaactttctactcacttgcatgtgggggaggtaatggggagatggggaaagaggctgcaaggtaccctccttctttcttatttccagcagtgagaagcagctgcggagaaagagttaaagaagggagaaagctccagccattactacatccctggtgcctagagctgtctggggggtcatgacagtgctgtctgctttggctaggggccactccgtggctttctgcagcagctgctggggccccccaagcaatttgcaaggtcagtgctgacctgcttccaaagaggaacaaaacaattcactgacaatgaagcaaatcacgcatataccacatcgcaaccccccttcctcaaatcgggttttaccccagtgtctccctgctcagatgccgcctctgggcttccaccagccccactggggaacccaggatagcatcacagctgcagagcatgcctcgcctcccggccaacccaaggagactctcagtacgggggagagatgctatcgctaaaggagacctgagcttgggggagggggaagaaggaacatcaatgtttcttaccgagctctacagtctgagcggaaaggagagaaggatgaatgaactgaaacaagttggaggttgagccctgacagagctcggcttctggcttcttcttctctctctgggtctctctcctggtccctctctcggtctgtctctctggtttgctcgctagcttgcgcgcgctcacgctctctcgctctctctctctctctctctctctctctctctctctctcaatctgcctccctccctctctgtcagtttctccctcccctcctcccctccccttctcccctccccctttgctggctttaggttcaccactggtgcttagcacgcggctgtgctggggctctgaatacagtactgcaaggctttagatgtggttgttttacgaaatactaaagtagtattttattccttaaggcatccaacagagaaatagagggaagcccagagagaaagggaggagcagaggcagcaaagggaagagaaagagagcaaaagggtatgagcgaataggaggataaaggaagtatgggttactgtagctgatgtgtgatgcttacttgctgctccgagactgaagagtgagcttcctcct

SEQ ID NO: 9734 - DNA, 1973 bp, artificial
  synthetic oligonucleotide
aagacagctactcacagtaaccacaaaccccatcttccccaggtggggctggctggcgcccatgcacaccccaggtgggaagaggaagaaactgatgcattaccgggtacacatccactctaggatctccaagcggtactctgaggggctgcacagcagttcctgaattgtctttggctctgtgatatacagaccctcgaggaaggggcagtttaggtcctaagcaaggaaaaggaaagcaacattcactgaaagtcccagtgtacatcatttcattttatttatttatttatttttgagacggagtctcactctgtcgcccagcctggatggagtgcagtggcatgatctcggctcactgcagcctccacctcctgggttccagcaattctcctgcctcagctcccagggtagctgggggattacaggcatgcgccaccacgcccggacaatttttgtatttttaatagagacggagtttcaccatgttggccaggctggtgtcaaactcctgacctcaggtatctgcccacctcagcctcccaaagtggtgggattacaggcgtgggccgccgcgcccagtcctcagtgtacatctgcaagctcccaggaccctttcctttacccgcgtcctgccatcttgccaagagttcaagtccccccattcttaaccccacatctcccgcggcatgcagaccccacctctttcaagtactcccactctgggctcttgtggcagcaggacctaggagcaacgcctgagactaagacttaagagagagtcctaggtttcgggactgagggaaaggggagagggaaagggagagggaccactgagccagtcgcggacaggatgggggagtgtctggggggaggagcgagcgggccgaggggacctgggacagctccctaacctcgtgggccagctttcctcactgctgcagtgagggctctgtcctgtggggctgtagagggcttctggaggctatcacccctggcatctgacaccaactgacaccaagccctagtctcgctgacttgacagagtggcacgaggctctgcccatctgtccccccagaccccgcaagatccctaaggccaggcctgggtcctctgtgtctgcacttgctccgagcgcccagcgcgggtactgcagttccacaggcggtgctggccccaactaccaggcacgggccgtggagacagcaagaacgaaggcctggggcacaccaaagggcaaagatgaatgatccacaagcaccccctgctgcaagggaacagggcgcagccggaaccggcgacggtggccgcgtggcgccgcggacttccgcagcaagccctcccgggcctcgggcggggccctccccggtcccccgccctggagtggctttctgggccaacagcaccttcagcttcccgaacacctccacagccgccctggacacgctgctgtcgccctcgtcctctgagtagtcgtcgccgccacggccgcagccagcgtcctgccccgccatgtttcgcgctccgagccgcgccccgcccatgccctggcttcactggccggcaagaccgccaatcaacctccagcgttcttcccgcccacccgcctgcgcccacccccttcccgaccgacccttcccattgggcgacatctccgcctgcgcgggccccgggctcccaccccccgccccggcaccacccagaggcaggaccacagtgaagcgggcagggcggacacagggaagggggcggggcggacacagggaagggggcggggcggacaccgggaaggaggcggggcggacaccgggaaaggggcggggcggacaccgggaaggggcggggcgaacgggccaagctggctctgagtcgcaggccttgctggcgtcgcccctgctgccggccgggaatgatgatgcgttgaagcgaggctcttccaggagggggcgctcctgccttggtcgggttctcc

SEQ ID NO: 9735 - DNA, 2234 bp, artificial
  synthetic oligonucleotide
agcctgggggtccaccggcaggcacgggggtctctttccaggtaggtgggaacgcgtgcttgtgggtgtggacaggtgtctgcactggggtttgtctgtgtgtctgtctccactcacaccggggatgtatgtgcccctgcgtgtctgtctctggtgcccacctgtgtgcagtctctgtgttctgcctaacggtggtgttcccgtgataaccgacggtgaggatctccggtaagcgccgcttcctctgggaagacgcatttggacgcccgtactctcaacaggtaatggagtttgcaggagaccaccaatgccttggagtccactgaggcaagacccaaggaccccacgctacacatcagccacccggctctgtgccccattttactgttggggagacgcacctagagggcagggtctggagaggtagtggcagcctcagtcgcaagctcagggtgctctctctgcactcacaggtgccatggtcccccagtttccatccccacccacccccactcggccagtgccctttgggggcaatgccaggccaggaagggcgggcaccctcgcgcgtcctggggacagaagggcgcgcaccgggcgcgtagctcctgagccccgaggcccctgcgccgcgcaccgccccccgcgcccgctccctcctccctccctcctcctcacccagctccctcccctcccccctccctccctccgcgctcagagctgcggttggagccgagcgcgccgcgtcgcccgccgccggtgcagagcgtggggagcactcggccgcagccctcgcccgccgcagagggtcgcgtcccgcgccgccggccaggccgccccgtgcccaggcctttccatccttggagcggatcgttgcccgcctgacgcccgcccgcagcgacagcgcccgccggagccgaggccgcggcggcggccgtgcccatgcccgggtaagtggtgctctgggcgcgcgggcgccgccggggtgggcgcgggcgcggcgcgggcacaaggcgcgggtggggatgggaggatgacccggcaggtggtgcggcggcaggtagggggacacgggtccccgcccgaggcacctgagccccgcgccgggcctgcgtgtccttgcggcactgcggccgcgcgtcaccccggggccccaggccggcgggcagcgccccgcaccctgcaccctgcgccccgcatcgcgcgcgcacgcgcatccgtgtctgaggaacaaggcccttgggggctgcgggccggggctcagggtgggcgcagccgggggcgcgggatctgggccgggagcccgccagtgcgcacgcaccttcccggagcctcgggcaccccctcccccccgcgccctcacactgtatcatccttcccctctcgccttcccgcaccgttccccgcacgcccacgcggctgcccagcagaccccaccgcggtcatgggcagtgcccacgagaagccgcccggggccgcacttaggtaacttctccatccctccaggaacggctgtctccccctcctcgcctgtgtgaccttggccagccagcttttcctgtggccgcctgcgttttctcacgggtgaaagctctggctttaagattctggaatttggaatggcaggtgcggcatctcccagagcctgagacgatgggcttctctctctgtgacctggtgtccttccttctgctggcccttctgggggttggtggctcagccagccggctgaggaggggtgggaggcagggcaggggcatggcgccggggcaggtcaggactggagggagtcttggagagcccgcggtgagggctccatgagggtttaggagagactgtggaaatgctccttcgctcactcaaggggcagggaagggaccagaattcctcaacgagatgcttgccatttcctggcgaggtcatataactttcaaagatgaagcccagggcctccgacctcaaaggagtccctgcctgctaaaggatcaagtccagcctgtccccaactggcccccatcctgaattccactggcaccctaaacgtcagccgacttcccctggctgacttgggcaccagtctggcaggcaccccctgcacctcctcccctcctttgcccactaggatctgtgccctcaccccctgccattgcccctcactagtcagtgaccatcttaaggcaaggactggctcttcatttgcacaggcctggcacagagtgggcacctggtttctg

SEQ ID NO: 9736 - DNA, 1332 bp, artificial
  synthetic oligonucleotide
catcgagtccctctgttggaccagggagcaactgaagcacagagcagaggaaggaatcttgccagaggggcctggggaatagggacagctcctttccagcttaagagtggctgagagagagtccaaggggtagaccacagtgacagggccaggctgcggaggctgggcagacccccacaaagactggccagcctggtggtggctgaggaggacgcacagaaggcccagcgaagtcctgggtgccggcaacaggcagtaggacacaagggcctcactgaaaccgccagggtgcttggagatgcggcacggctgcagccagaggagggcccgtgaggctgggccctggggagccataggaagcctgtggctggggtggtattgatgctggagctgggccggccgggggcactggcaacttctccagacacctggctggctgctgtgctgtggggccttggggagaaggcagggagcagggctgagcaggcgaggaaggacagcctggcctggccctttggggccatggggaaggaactgggctacacacactgggcctgaggagggaggaggcctgggttcgcagctgctggttttcaggctcgtcacggccacttggtggcagcagaggggtggcttccagacttttcagggacaggcattcgctggctcaaaggagaattgtcttcttgtggctcgtgatcttgttatccagcaccccaagatcctcagagagtacgaagtgtccccgaggctggcagtgaggccacttagtggtatatgctgcaggaaccattggatcaccctgtcacagcttagagtggggcccccagctgtctccctggcaaagatcacagcccccctgcccatggcctcagggggcgccaggattcagggactcccaggtcaatgtcctcccctggtgtctcccggctgccctacccctggctcccactcctgcgtgtctactccccaccgccgcaggctccccaggcctggcggctcggccacacctaggcttctacacttacccgacggtgctcacaagccccactgcctaggcttgacctcctcattcaggttcccaaactctgaacctggctcctcttctcctctccccctgcccgtctacctcagtggcatcagctgcctgaccctgtctctctgtccccgagcctgaagagccacatacctcttcatttgggaactgtcttccctgtccccccaccactgggacaatgccaccacctcccggccagtctcctggcttcccgctctcaaccccttgcaggctgttcgctttccactcagcactggggaacctctttctctttc

SEQ ID NO: 9737 - DNA, 915 bp, artificial
  synthetic oligonucleotide
cttgcttccccttcaatttgcaggaagctgtaagagtggggacaaagcgaagccacggctgccagtcggtgggaaaaccccctcctccgctaggtccattcttctgctgaagtttcgagggggcgccccctgcccagtcactcagatgagccacagaagctggcggagacgggcaggcggatggagcatggggcataagtcctccgggtttagaggaagcagggcgggttctaataggagcgtgtcatgtccctcaggtgtgttggagaggaaaaacaaggttgagaactatgaagtacttcctgataagtggcttgcaaggggcatttctgacatgtttgcagtgtgccctgacttgtgacccccttcccttcccaatctcatgaccactaaccatctgctcagcaaaccctctctcggtgggtggcacagaggctggcctcagtcagggccctgtccaaacatcgccagctcccagtgagcggggtgacccgatgaggctttgctgtcaccctatgtgcccagtggtggcccctatcctcgcccagccctcccctccgtgatagcctggacaacagtgcaagccaaactttatctcattttctctcccacagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggagtgagtcttgacttcccttttctctcataaatggcatctctggggaagaataagcctccccagctcggccttctctcttttgcagtcttgcattccgctcaccgtggcttttctgttctttctttaccgccctgtccagtccttccc

SEQ ID NO: 9738 - DNA, 1846 bp, artificial
  synthetic oligonucleotide
gctcctgttctcttcctccaacttcacctcagcattcccgacatccaacttgcctccgtcaacagcagctccctgggaaaagtgccaaaggccagggttactcaggagggagggagggagaggttccagccccatcctccccaccgagctgcggttcctcaagctgccctggccacacgccccttcggaaatgtcaacgcggaaccgagccaccacttgctcccagctcctaggcaaaggccagggcgtggctgcccgccgagggaaagagaagcgccagcggggccacctgctgcagctcgccgggcacgccttgcctgccctggcccctggcccctggcccctggccctgcctccttcccaagcagcagggctcagcagctccatggtgctcaccaacccctccacagatggcggtgcctcgtgctccctacatggtgccgctcactgcagttaggagcccccagtcggcctggccagctctatcccacctctgcatccacatccctccgagcttgccttgcagctcacctcctgacgggacgtctaagactggccaactaccctgcccccacctcctctccagcactgagggatgccacagaccccgagttccagagggggtgcggcaatcttgcagggaacaagggcctagctgagggccttcggatcacagcagagggcctggctcactgaggggccatttttctcagggaagggtctaactggaagcagtggatggaaacgagagcagcaacaccctcctcctcacccggaccctcacacacagacgcctccagcaggcatactctccccactgaggacttcccctctgcgcctccacccaactctggcttttcaggcacatttcccagcgtgacaggctagcagtggccactgaggccctgaagaatgtggctcccacagtgtaacaccaggacgccccatggtgggtcgggaagctgggctcaccttcttgagctggtcattctcctccatgtacttcttggccgcctcactagcactctccgcctgctttttaaaggcttcattggaggccagcagcgtggcctgctgcgaaatgagagtcaccaggcgtctaagcaggctgcaattatttacaaaaagaagggagaagtgagaaaaagagcatgaagggctggcaggagcacctcctggttgctcccactccacacctagctccagcctggacctgccctcttgccaaggcagccgagtgagaagccgccaacctggtgctggcagcgtgagggaaaaggtggggcccaggagccgtcctctgccgctgtgcccaacggccaccctcagctctcagaggggctggaagcaggagcctggggggctgggaagagcctcgctacagcatgaggtcccagaacgcggcactttccgggtcggggcctagacgtgccagacaagccacagcaccaccttcctccctgcgaggctgggcttgccttggtaaggtaacgagagaagctaatcaatccaagcacttccaacatgccaggccgcatcctcacatctacctgatgaggaagttactatcactgccccagcttatagaagaggaaactgaagttcagcagcgtaaatcaatgtacccaaggccaaaaaccagaaatggacatggctggaattccaaattatgtctgcctgactccagaacctgagctcggaaccactctgctctctaaactaacagggaacagctcccaggtcccaacgtaagatagaactctcttctctggccagcctccttcccaacccatcatgcaggctgcgctggaacacatccgttatgtaacagcaccccgaatgaggt

SEQ ID NO: 9739 - DNA, 5455 bp, artificial
  synthetic oligonucleotide
tgcaaataaaaacaaatgagttcgggccaggcatggtggcttcagcctacgatcccagcactttgggaggccgaggcgggtcgatcacctgaggtcaggagtatgaggctgcagtgagccatgactacatcactgcactccagcctgagtgacagagcaagaccctgtctctctctctctctttttttttttttgagacagagtcttgctagagtgccatggcgtgatcttggctcactgcaacctccgactcctgagttcaagccttctcctgcctcagcttcccgagtagctgggattacaggtacctgccatcacgcccggctaatttttgtatttttagcagagacggggtttcaccatgctggccaggttggtcttgaattcctgacctcaggcgatccacccaccttggcttcccaaagtgccgggattacaggcatgagacaccacgcctggccaagaccctgtctcttaaaaaaaaaaaaaaagaaaagaaaaaagaaaagaaacaaatttaattctatatcaaattgacaatataccacagagaaaagatttatttcaaatgacttttgactacagtgctctgcaaacctgtagtgggacatattctaaggccaacaataacactccaggggcagtaaacacactagattggctcccaggagagatatgtgattctgcttctggggcatcttgtgccagaaagcccggggagtgcaagagaaaaacagggagggcccatgagaggcctctagcagtggtccaggtgtggcccagggtgggggcagttgaggatttggggctggtctaggtggtgaagcaacagagctcgcaggtggattagtgtgggggtgaggggcaagggtgagtcagggaccatgtccaaagcctgggaagatggtggtgccactgattgagaaggaaaagactgaggggccggctgggtgcagtggctctcacctgtaatcccagcactgtgggaggctgaggcaggtggatcacctgaggtctggagttcgagcccaacctggccaacatggtgaaactccgtctctactaaaaatacaaaaatgagccgggcgtggtggcaggtgcctgtaagtcccagctacatggaaggctgagggagaagaatcgcctgaacccaggaggcagaggtcgcagtgagctgagatcgcaagactccgtctcaaaaaaacaaaaacaaaaacaaaaccactggagcggcaggggagcaacacccacagagacagttataccatcaaggagagaaaacagttcttcagctactcgctagaaaggggggaaaccccgctgtgatcagattctgagttgggcctgaatgaaaatgaactgtctgcttggggttttaaaggctttttattgtggtaaaatatacaaaacaggtcaggtgtggtggcttacacttgtaatcccagcactttgggaggtgaggcaggtggatcgcttgagctcaggagtttgagaccagcctgggcaacatagcaaaaccctgtctctacaaaaaaaaaaaaaaaaaaaaaaaattagctgggcatggtggtgtgtgcctgtaatcctagctactcgggaggctgaggcaggaggatcacttgagcctaggaagttgaggctgcagtgagccgttgatcatgccactgcactcctgcctgggcgaacaaaccagacacatatatgtctcaaaaaaaaatacatatatatatatatatatatatatatatatatatatatatatacacacacacacaaaacaaagtttacctttttaactatttctaagtgtacaatgaatgaacttttttttttttttttttgagacggagtcttgctctgtcacccatgctggggtgtggtggcgcaatctcggcttactgcatacaggctctgcctccctcctgagttcaagcgattctcctgcctcagcctcccgagtagctgagattacagatgcgcaccaccacgcccagctaatttttgtatttttagtagagatggggtttcgccatgttggccaggctggtcttgaactcctgacctcaggtgatccacccacctgggcctctcaaagtgctgggattataggtgtgagccaccatgcctggccctaaatgaacttttaagagcactgaagatgggaaataaagggtctttaactctactgtaatattctagttctttctaatggaaattacttgaagcaaatatagtatgatgattttcaattctgtgcaatgaaaggcacatgggtgtttgttaatttgctggctgctacttttataattaaagacaaatttcaaaaaacccacaaagaagcctggattgtgctgggtgtggagtgcaggtaaaaatgataaaaaacgtggatggagctggagtccattgtcttcagtgacacagctcagacacagaaagtcaaataccgtacgttctcacttagaagcaggagctgaatagcatgtgcacatggacagagtgaggaatggcagacactggagagactgggaagggtgggagggggtgagggatgagacattacttaacgggtacaatgtccactattcaggtgatggttacactgaaagctcagacttcactactatacaatatatccacgcaacaaaactgcacttgtaccctttaaatttaacaaataaaaaacaatgatagaaaacaggtattccaaatgagtttacccttagcccagagggcctgcccagtcccagggtgacctgggcatttgcacaccctcactaagccttcactgcaggacccaagggagggaggctgggctagggtgccaggtgactccccaaggctgtcccccagggggtttatggtgtttgccgaaacacaaactttttcaaagaaacctgccaggtgtggtggctcatgcctataatcccagcactttgggaggccgaggcaggtggatcacctgaggtcaggagttcgagaccagcctggccaacatggcgaaaaccccatctctattaaaaatacaaaaattagctgggcatggtggtgcatgcctgtaatcccagttactcaggaggctgaggcaggagaatcacttgaacccaggaggcagaggttgcagtgaaccgaaatcgtgccactgcactccagcctgggtgacagagtgagactccatctcaaaaacaaacaaacaaacagaaaacaaaacaaaaaaaaccccatacacctctcttcatcctccctctaatcagaaccccccacacacacacaatcttgattatgaggagaactaaatagctagttcacaagttcatacattttacagttgaagtatcctcagaaaaaccacctattcaactcctgagtgttacagatggaaaaaaagaagttcgactagacagaggaacttgtctgagatcaccgtgagtcaaaaacacacgtgtctgttcaccaactgccttcgtcctgagccagatcctgcagcatccttccacctccaagaactcacagtttggaagggaggacaaataggtaactacaacatagttccagcctcccttccccctgaagaaagcttgctccaggcacagcggaagcacaggggtgtggataatgaatcaggagtgagtgggctgtcagggcttatgagttccacaggtgggacagagggctcagggcatgccaggccagatgggcagaggcggcactatcaacatggttatagctcccaccctatcacccgtgtgacgcccctccctcgaggaaaaagtgaccaatgatgcccaccctgtgtcaccagaggctctgggcctaaccctgtcaccccctcccaccttttcatttggagaactttcaggttcatctggagaactttcatctttcaggttcagttaggatggcacttctagaccgggcgcagtggctcatgcctgtaatcccaacaccttaggaggccgaggtgagcagatcacttgaggccaggagtttaagaccagcctggccaacatggcaaaactccgcctctactaaaaatacaaaatatttgccgggtgtggtggtgtgcgcctgtggtcccagctactcggggactgaggcatgagaatcgcttgaacctgggaggcggaggctgcagtgagttgagatagtgccattgcactccagaccaggcgatagaacaagattccacttcccaaaaaaaaaaaaaaaaagatggcacttctgagacaccttccctgctcctgcctccctccctgctctatgagccagggcacccgagccctcagtgtacttagaacaccccactgtgcgtgccaacccccatctccccgctcaatgcataatgccaggcacaggtgcaacccttactcaacacatgctggatgaataaccacaacacggacgcagcgctccacgtgcttcttctgatggctggagaccttcgaccgtaagcttctagcaaggagaggctagctcagtgctgaaaaaaaggtgggctctgaattggtgaataaacaaatgatgagtttgggacatatcagtagtccgttggacactggtggcttggagatggcggaagatgaggtggaggaagtcactgaggagggcctcagtgccccagggacagtagcatggaggatggttacgccagaggatggatcgacttctagccatgtggtggtcaggtatgcagacacctctcctgctgaaacaactacaactgccaaactgagtatcttacagaagctgctagagaagccacccacaagctggcaagaaaggaaggaatacacaggctgaagagcaaataaaagtacggggcccttttctgtggagaaatctggcaggcaccaccttaacacacgaccaaactgagctcaggcccctcagtgctgctgagatgaaccagcatcacgagtaggagactgaagcttaccgtgaggagacagcaggaagagtccagagagggcgtgccatgcaaccacggtctggactcaagatgatgagagaaaacaagggggtgggggaacatttctgataaaggagactgaagggatgacacaatcgaatacaacacacagtcctggactctgcattccaggctcaaaggctctaaaaaaggcatttatggggtatgtggagaaatgtaaggttctgtgttagctcattgctaaacttcctgagtgtcttaactgtactgtctgctcttaggaaaggcatgcttaaacgtttaggagtgaaacagcacgaggactatgactaactctcaagtgatcaatgggctaggggaaatacagtgccaatatggtaacatgtttaaaagaagggagatgacatcaatataatcagaagctatgccaactgacagtaatattttgaagcagtggtaggcaagctttttaacaattaaagagaatgccttcatattacacaaagacattaagaaaaaaagctg

SEQ ID NO: 9740 - DNA, 859 bp, artificial
  synthetic oligonucleotide
ggccaactgcctacatgtaattgccacttgacccttcaaacctcaaagaaaccgaagtacagacatatgaaagggaagaaatttctaacagaggcaatagcaggagaggacctctgaacggataagatacactcagcaaatttctagatgctggaagtaggcaagaacatgttgactaatggaacagagaggaatgtactacaagagagctgtagagcagatgagagcctgtatacctgtcagagccccaaagaagctctcagaccagaccagaccagaccagaccagaccagacgagaggaggggcaagcagtgctgtcatgtgtgcaacacctgggggctgctgactgccagatcccgacccacaagctttggggcagggcaccttcaataagctcccaggtgaggctgatgctgttggggctggtgagcagagcaaacttggagtggcaaggtgccacttcttccctcaggcaagaaatcaatgggtcttttctaaatcaacagctagaaccttcccttccccggcccccaccccacccaccccaaaggctcttgatgtggctggcagcagcccaggtgatgcctaccttttcccagtctctgagggtccatggggcaagagctgacccctgcctcgcctccacagaacttctccaaaccacccttcagagacagaccccgcaggcaacgggccactccaccacagcagagaaggggcagcgcagcagctacccaggtcctccccccatccctggcggctcaagaaccagccccatggaagagagaccaagtctgtccttagaggaaacaaataatattctcagagaaatcttagaatacagaatagtcataaaat

SEQ ID NO: 9741 - DNA, 452 bp, artificial
  synthetic oligonucleotide
agacctatttgcccaacagcagattaaatccacaatacttatccagtccttccttattaaatataaaccagtcagtaaatattatcagaaatttgatgaaagccttcaacaggaaaaagagtcaagataaacctgtagaaaaaatataaacttggaattcaagaaaattcagggaatgtatcaaaaaatttaatttaattaacatatctacagaactaaaagaaaatgctgtattcataaaacaagaacagaatattatgtaaaaagagcaatcagagaacaagaaggaattattgaaattcaaatttcaatagaaatattggaaaataaaactgaagaagtctcccagaaaatagaacaaaacaatagagacaaagatatgagagaaaatatgaggactttgaggagtgatctaggaagtctggcaagcaactaacaagaattatggaaaa

SEQ ID NO: 9742 - DNA, 1135 bp, artificial
  synthetic oligonucleotide
ctggatggccccgccccatcccacccccctttccccagcccctgggccagccaacccctccctcccctaatcactgctgctttccaacatttttttgccttatatggcaaagctctgggaactaggcctgctccagccagctcacaaggaggaggggagctgggaggagggaggagaccccccctaaagagctggggtgtggcccgcctccccacatccggtcgccccccctaccatccaggactgagatgactcagcttggctagactgaggctgggacttgtgggggtgggcctgcccctcgcctcaactggcattccaaagaaagaactttggttcttgggatctgccctctgagtggctgggggaacccaagtcttggtccctcactttcttgggttcagcaagggccattccagggctgcagggtaactggaaggcctctcaattctgaagaagagaagactcatcatccctctcctctccctgttccacatcacccccgagtcacccattctggggcctgccctctcatgcagcccctatcttgagaacgaattgggctgctgcagcaggcctggtcaatgccagcctctccagtccagtgacacagacactgggctggcacaatgcacgctggagcatctaccaaccaactcctgcgtgctacacgcagaaaagcaaggcctacatggaagcaagagtttggcccaagatgaagagaaaagttggcgtccaagtagtctacaagccaggtctctcagtcaaccacgcccaactcaccccgggtgcagttttgctaactatgcttctttctggcccccaggttgcctgtgtgtgtgtgggggggtagatctaaactggtggttggagccatctccgatgggcgacccatcctccagggacacaaagagcccagagccccagacaatgggacgcacgagctccaacccacacttcagaaccaacgggcctctgaaggccagagggccctctctaaacagctgtggggggagagcccgggcctcctcctcctcggggacggggcgcagggccaggagcctgcccagtgcccgaccccccaggcccactcccaccgcgagcacagccgcggaggcgcggcctgcggaggatg

SEQ ID NO: 9743 - DNA, 862 bp, artificial
  synthetic oligonucleotide
accctggaggccttggtccagccatgtgtcttacctctgaagagggaggcaggaaaaccagtggggtgggagaggcaaagtacaggagctaagatgaaggcaccaggactgaagccaccggggtgatacaaaccagctcagaagggaaaggctaggggccatccaccccatgccccatccctccagtagggctggcggctctgagtcactccaagaggggtttggcccagatcccacaccatttctgcttgaggggccgacagagtttgagcagatgcacccacaaggcaggggagggagtcccggcccttccaaaacggccaagtgttcggggtaactggcagtgctaacaggggctcctccctacctgggagtccggaagttgtcggacgggtggctagcagagctcgggcgcgaacctgggagggaggaaaggaagggcacgccgccgtcccacagccggcgacccgctcgggccgtctcggagtctgggggggccccttacgccattcctgggccccgcggccccgccaggcctcgcaaacgcgcggcggcggcggcggcccttccctgccaggcccggccgggcgcccgagtgggcgatcgcggagcagggtcggggccagaggccgcctcccttccggaggctctcacctgccacagccaccgcgcagcttagctgcagcgtctgcctggcaggcagtcgcccgcgagctcggcctgtcagggccccgccccaccgaagcccctcccttccccgccccgcgcgtcagggccccgcccccccctcagcgtccagctcaactccggctgctcgctgggctccgaccggttgtgacgtctctgggagtgacgcgccggc

SEQ ID NO: 9744 - DNA, 1435 bp, artificial
  synthetic oligonucleotide
atgtgcacaggaggggtcagcaacctgccttcagagccaggctttccaactcaggctgagggaggagaacctatacctatctgcatttggagctctacgttttgatccttcaatactgctgtcatttcagcaatgacactttttgactgaatctgccaaaaggaattgtgtgggcctcttcccctcctgacccatggacgtgcttcatactgtcctggccaagagcgcctagagcgccaggattttggtgctcagattctgattgttctgattgcttacaggtgttggtctccttctgcgctgctttttcagtggccttattgaccaggtataggagatgcctcagattaaaagacaacaaggagaaaaaaaaatgttgctaagatcctacctgaaccaactgtgaaaggctttcaagttgaatgtaaattgatgagacgttggagatggaactagcttggggagcagttggagttacagatagaacacagaaatcctggaaaccaagccacacccagtaaacagcaactggctccaactttccctgggatcttagcctgtgctgacctaaactgtatgctctgtgaaggcaaggacgttgcccatcttggtccctaaagtacctccaacatctttaacagtcttggcatacaatacgtactcaatgtgttgttgtggacagcatgactgactaaagtatggctataaaggggcaacacaggggatctttgtgatggaacagttcagtattggtttcagtggtgggtacatgactctacacaggtgatgaaatcacacagagctacacatgcacacacatgcacgtgtaaggggtgacatctacagctgctcttagagggtatcaatgtcatttgctgttgtgagaccgaactagaattatgctagatggcgacactgagggaactggggggaaaaggtgcactggtttcctggacatttctttacaacttcctgtgaatctagtgatttcaaaatagtaagtttacaaaaagacactcaatccaaaggaaattttaaaagtgcagaaaaagaaacctagaaaagatagggcaaataaaaagcacaataagatgcttgactttaatccaaaggcacccatgattactttaaatgtaaatggactcaatgctcttgtgaaaagacatttatccaatgcctactgtgaaccaagcccggttggttgcaagggaaacagcgaagaatatgacccaggccctgctcctatgatgctcggtgcaatgaaccaagaactgggccaaatgctgttaatgagtgccacctggatgagttcgtaactgccagaggtttggagtgacggaagatgaagctagagatgtggcagtagcagacaagttgcaaggagaattaacaggactgggtcaccaaatgcatgtgggccaccagggagaggaaa

SEQ ID NO: 9745 - DNA, 157 bp, artificial
  synthetic oligonucleotide
tgtactcagtttgtgaaaattcatccagttttatacttgtgatttgtgccctttgttgaatatatgcccatatatgccaaaactgcaatttaaaagtttacttaagaaaattataccgtcacactacaagtaacctgcaatagaaacttcagattta

SEQ ID NO: 9746 - DNA, 512 bp, artificial
  synthetic oligonucleotide
aggttacgttttgttttcttggaattcatttttaaccccatctccttcattcctgaacagtaatgtaatttatgatctttctataatcacctcctcttaatagtagcagaggatttctttcaggaatccaaaattcagattaagactcactaaccttcatcaaatacagcaaaaagtagtataaatttgtgcaaggtctgtgtcttttccttggccagactccctgaaaaagaagtgagaacatttatcttctatttaaaaaatctcattgtaggaaattgtcactaggaggagacagttcttcatcagttacttgacagtaagaacaaatgtagtcttctgtctcttgataacttggctttgatgtcaggtctcctatagcagtgtttctaaaactatctggagcaaagaatttttttatttcaactttgatgaagaccactacttgtgtaaaatatgataaaaatgaattactaaagaaaaaaattaaaaacacttacaaaatacaagcc

SEQ ID NO: 9747 - DNA, 375 bp, artificial
  synthetic oligonucleotide
caagcagacttacatccccacaatcctggccccgatcagaccctacaggacatgcctttaccttgcgtccacaggcagctcaccgagatcactttgcatatagtcccatgacagttccactgcacccaggtagtatcttctggtggcactaaagcagaatcgcaaaaggcacagaaagaagcaggtggagagctctatttgcatgacttattgctacaaatgttcaactggagaagcaaaaggttaattcttctctaaaatatctttagctcccaggaggggaaaaaagtaaaatttctgatttaatgaaaagtcccaatttctttgcagagcattttaaggaactttacccactggatgtgctcagcactaagc

SEQ ID NO: 9748 - DNA, 1290 bp, artificial
  synthetic oligonucleotide
gtcaagccaaagcttgtactcaaatagttttatcatccacttaagcgatttctttactaaagtagaaagtaaaatgcaaattcttgtgtagtgaatcaatatcatagacacaaatcttcagttctttcttatcatttttactttttttttttttttgagacggagtttcactcttgttgcctaggctagagtgcagtggcgtgatctcggctcactgcaacctctgcctcctgggttcaagggattctcctgcctcagtctccagagtagctgggattacaggcatgcgccaccacgaccggctaattttgtgtttttagtagagacagagtttctccatgttggtcaggctggtctcgaactcccgacctcaaaccatccgcccaccttggcctcccaaagtgctgggattacaggtgtgagccaccatacctggcccatttttacttttttaaaaccaagggaatagaggaaaatactatgaaactaaaagtttaagcttagctggaataatttatttgaaacaatttagaaaatgaaggtcatgtaacttttgcaagacctttgaaaattaacaaacttaattacaactttgcatttcattgccaagcataagaaggagttttactaaagctatgtaaataattgcattaggatatatagcagagacattctatatatatgtatatatatgtttaatttattttcctttttttttttctgagacaggatcttgctctgttgcccaggctgaagtgcagtggcccatcttggctcactgcaacctccatctcccgggttcaagtgattctcatgcctcagcctcccaagtagctggggttacaggcatgcaccaccacgcccacctaatttttgtatttttagtagagactgggtttcatcaagttggccaggctggtcttgaactcctcctgacctcaagtgatccacccactttggcctcccaaagtgctgggattacagatgtgagccaccgtgcccagcctacttttctagttctagttattagttcgaattcccagacgttctcttttttaaatatgaattaatccttttttctgtgacataaacaaatttggatttattttttagctgaaatcatgatcattgaaacaacctaagttttagaagtaaatgattcttgaagcagaagcactcgtaataagaaaaataactttacatatctcattctgaagctgtaacacttttgtcattgcagggacttgtggtatgttaggcatgaagaaatgcacacctttcagattttaa

SEQ ID NO: 9749 - DNA, 622 bp, artificial
  synthetic oligonucleotide
ataaattttggtaagtgatgacttctcatttgttttctttattaaagctgtatgtagagacatggtaacctattcagattgttttgatagtttgaaattctgtttaaattatccctaagatgagaacttagcaagagtgcttatatttatcacaattttttaaagtctgaaacgtttttggtttttctttagatctttaaatggatgagatggctaccactcagatttccaaagatgagcttgatgaactcaaagaggcctttgcaaaagttggtgagtattttttgtagtaaaactatagggaagcaatatttatttggtctcaaagttatttctctataaatatcacatgaatggttaatcaaaaacattagggcaagatagttaaaatagatgggataaagttttggaagctatacttaaaattgttttatttcttttttttttttttggtcgagtggtagctgatattatttccaattttatgtagtatttaatatggtcaaattttttagaccacagttccaatccttaactggtgactgttatgtatggttcctgaaattttcatgccaaattttagttattattatattttgtatctcatatctttctgaagagg

SEQ ID NO: 9750 - DNA, 1302 bp, artificial
  synthetic oligonucleotide
atgagttccttatcctcgtttgaaggataaggaacttgaaggattgtgagtcgttctcagacacgaggttagcagagctcctttttccgattaatagaccagtactcttagacttaagccctgttgtattctgactattccttttcctattaactgatacactgttttttgttttcttttgttttttgttgtttcttttctgagacagggtctcactctgtcgcccaggctggagtgcagtggtgagatcagagctcaaagcctcgacttcccaggctcaagcaatcttcctgccttggcctcccaaagtgctgggattacaggtgtgagccaacgcacctggcccagatctatctttgaactcaagtcctcacatgtttgtgttttgtcctttgcctccatgggtgtttctctttcacctagaaattctcaaattttagagggcacccaaatcacctgggatacttgttaaaatgtggattcagggacctcaaccctgagggatctgatttagtatgtctggaggagggactcaagaatctccattttaacaagtatccatgtgattctgatgcagggagtccaaagaccaccctttgagaaatgctattttagctagtttgaaacaaagctccagtcaaataattctgaaagtgaaaatgctggggtattattcaatttgagtgttgtgttgccttgagttatagggctcttacacaatgtgaaatgaataatgtggaatgctgttcactgcaataaaatgtcaacatttcaagtattttttcaaaagacttcttaagagttgctctttccacacacggccctgtttaaaaggaattacagctgctcctacttttatagctagcacatccaaatctgcctataaaatatttaaaatgaacaaagtacaattacagctatatttacagttgtgtggaacaaatccattgccttcaaaattataagtctggctaagtaaaaccaaccaaaaactctactgaaaacaatggaatttttaagcacataagcaatggaacaaatcacatgtggaaaatcaatagatttagaatacacaaaaatggaaaaagttgaagctcaaaaaccattactaaacaagaaaacctaaaacacaagccacaaactgggaaaatatttgcaacaaacattaagaagggttgatagatttgaaatataaaaaagctcacgaaagtcaaaagggaacatggataaagaacaagaacagagataaatacatatgggaaagtttaagaactttatggtatacatattttttaacattca

SEQ ID NO: 9751 - DNA, 475 bp, artificial
  synthetic oligonucleotide
agcaatatattcttgtcataaaaagaatttaaataataacgaacgtatcattaaaaaaaaatcaggtatgcttccctcaacactgctcctccaagaaaacttaacagattgatgcgtagtcttacaaattcctttcaattcttataaggatatctatgccttgtccaaatctctctacattttaagagaataaatgggatcagagttgtttgaaatttgctttttttagcatcatataagtagaatgcttactacattagtacataaagtatttcatttttaaacttatgtgtgtacatttttgtttaaaattgctgtttctcagattataaaaatagtatatattcactctagaaaattcgaggaatacagacaattataaataagaagattaaaaacaataccactaaaatataaacactggtaatgttttggcatatagtcacttagtcttttatctgggcaagagaataga

SEQ ID NO: 9752 - DNA, 448 bp, artificial
  synthetic oligonucleotide
gaattcctagcctaaggcgttaccaatctgagttaatgaaaatcttctttaatacccaaccagttttattacttgaaagttttcatggcagaactttaggcaccttggcaattccgggggaagatagtttggagatggccttataattcagagtgatcttctcagtggtgtaatctgtgtggtgcaaagcagaatccctgactccggtcactactcagaccttattgaatctgcgaggcgaagagtgggaaactgtttcttgtcatactttatggcccagacaaggcaatatgagtttattttgcttcaggggttgaagtttttggagccctccttttcctatttcagttccactaactctaatgctattgaagaggtagaaggtgaggcacatacaaatctagtttgacacccacaagtaagctacctagtgtcaattgaagaatga

SEQ ID NO: 9753 - DNA, 383 bp, artificial
  synthetic oligonucleotide
tacaaaaacagacagggcactgaacttggcgtgcaggttgtagttgccaactcttcctctttggcccagcctcaggaaacttctcttaggttccatgcctgagagtactctaaactataagaaccacatccacttttggaggattcaataaaacacctgcaataccagtgggtagaagtttctctttcctcttagaaaaattggcagtggatgcagtggtggaaaaaccagcagagttagaatgggagatattaagggactggataatggatgtgagaatgtgtgggcaatcatagcagagaagaaagcgtgaatggtgaggaatttgatagcctgtttgaggaagaagaggaatatggacattgacaatccactgctcactt

SEQ ID NO: 9754 - DNA, 984 bp, artificial
  synthetic oligonucleotide
gctgctgctgaactattaacatttattgattccttactataagccaaccaatatgctaactgctattacatgcattatctcattcacttctcttaataaccggatgaagtaggttattatccccatcttacagatggaggcattggagcttgaaggttaggttgcttgcccaagttcactcagctttaagtggctgagtatggagtcagtccatgtcagtgattcccaaaaaccattctactaccatcctattatctccagtcttggctttaccacttacctcaggcaagtcatttaatgtttttaaagtacacctatgctatggtctgaatgtttgtgtattcctaaaacttcaactgttgaaatcctaacccacaaggtgatggtattaggaggtggggcctataggaggtgattaggccatgaaggaagagctcaggattgagattagttcctttataagaaaccctggagtgctagctcaccccttccaccatgtgaggacacggcaaataggcactatctgtggaaaaagaaacaggtcctccctcaacaaagaccaaatctgccaatgccttgatattggacttcccagctcccgactgtgagaaatacatttatgttgtttataagcttcccagtttatggtattttgttatagcagcccaaacaaactaagacagcctatgaaattgaaataataattcccaccctcaacaaaacaacgcattgtgaattcatcattttgaccctgagaatgatgaaaccccaaataaagactggtcattagaaagatcctgtaatatctaatttcacaatctgttatgaatccaataagaaattaatataaaccttttgcatttttatccaattcaatataaatattactggtaaaaaaaacaatcagcacagaataaaactgaaaaagctgaagcaaaaccaactatatttgataataaaaaattgttgtagatgaaaaactaa

SEQ ID NO: 9755 - DNA, 250 bp, artificial
  synthetic oligonucleotide
agatttctgggagtttatggaaaatgttattagcatgctctaccaaatatttccaacgactcaagaccgtggcatgggtagtttgggacagaaggtggccaactgcctccttctgttatcttgtgtatctgaatgtggctcactgatttgttggttgaattgagaacttttatttaaaagtcttcccacctgccagttggtcttattgcatctgaattttaattattgttggctacagcaaataatcaac

SEQ ID NO: 9756 - DNA, 5779 bp, artificial
  synthetic oligonucleotide
tcagcctgtgaaggacataaacttcagctgttgtatgtgaatatttgaataattgcttaggacagagtttagaacaaccagccaagtggatagttctgattccctatgcatttactgattatcccaaaaactaatgttgtgtagctgtctttaaaaaatgaacatagaatcaatgcaattaatcccactgacaatgattatagctcactctgtgaaaaccatttctggtaacgttacaggtaataattcaattaatttgatccattatgtataatggttttaccttgtgagtctggggaatagaaaacgatcttttgatttaagatacatctctattattcatgaaacgtatggtcctgaaaagggacgatcaattcatgtaattgatttgatatccttgttgtgagtagaagtgttgaacgttatttgacaggaggatatgagaattaagtgattctatgcaggatagatttagcttctagtttctctgttgcttgtttctgtttttgtcatcataatggactcaggatcattcatttccaataagaaaatgtcatgcaggaatgatgacttatagcagttttcttagatgactttctttattggtttctgttttccttagaatcagcatcctcttgccatctctaatctcatttgccccatgataaaaggttgggccggaaagtacagaggatgctttattgggattcaacacaccaagtgcttcatgggagaagaaagacacataaaggtttgggttaggcttcttgagatggatacaacttttaactcatcgaggggcatgaggaacagggtatatctgggaatgtctgcccacttctggctgggtgtgcagggtgtgcgtgtaaagtgtcaaagacttccatcctcccccatgttcgcctgcctctctgggcaaaactctggcttatcttttactacaggtgtgacaacgctcttctttcatgacacgtctccctgagagcaagggtggcattcagttggtctttgcatcctcaacttgtggtagccaggcacacaatgagcacgccgcgcatatttttatactgaatgaatgaaagcgaaaaccacccaggagaggataataaaaggctcatccgaggaattagacttgagtctgggggtggagccctgcccgcaaaccctcctctttccatcttgctttattctcccactgtctacagcagaacctcttcattctctttggggccaccagcccaggacccaccccacttaccctcagcagatgaaaagaagccctgcttatgggaacaatagaagtcatcagttggaatgactttatcttcttacctctaaatttaccagcatctgcacactttacttttattctctttttataagtatgctttttcccatgaaagccaaactgtgaccttatcagcatcccttctgtctctcctgcattgctcaagtctcctctctactgactttttaaaaaaaattttttgaaacagtctcactctgtcacccaggctgcatggcagtagagcaatcatgactcaccacagcctcaatctcctggactcaagcaatcctcccacttcagcctcttctgtacctgggagtataggagtgagacatgagacctggctaattaataaaaaaaaattgtagaggcaaggtcttggtgtgtttcccaggctggtctcgaatccttggcctcatgcaatcctcccgcctcagcttcccaaaacactgggattacaggtgtgcaccaccacacccagcctctactcgcttctggtcatgagcgcttaaatatggcagtgtctctcctacgttaaacaaaaattcctggctctcctattccaattaaaaaccatgtttcctctccccttatttaaaagctgtttatagtcactattttccatctccatttcccctgtgctccataacccactgtaggcctatttctgcacccactgcttaatcgaagctttcttcttgctatagccagtgggcatggtgtcatccatatcatacttggcagcttaagggtgctggatacagctgaaccccttcaacctggcttccaggaaggcccctctccaattttcctttctgctcatgttctctgtccgtcacctaaattcaagctggtctgtgtgttctcctacactgaagcagatgtaggggttggaaatctctgaatatgaaataagttcccagaagattcttatactctgacctctcagaagcatatttgcaaggactcatattcctcagagatctgcccatgtcttcaatgtatcgtttatgaaagacattggcaatccacaacccattggccagatctagatcaccacctgtttctgtaaggcaacttgtattggaacaccaccaccctctccccacacactgaagtatttctgtggctgctttcaggccaccacggcagagctgagtagtagctgcaacacagaccatacagcccacaaaccctaaaagattttctatcagaccttttggaggaaaagtttcctggccctggtttagaatctcccagttgcttctggacatcaatagccttctacatgtgtgtctcttgtgcttcagacccggagaaccaacagctcattggaacctcatgtgaacatgacacagacccttcaaaccaaacatgctcagttgaattttccatcttcttcccaatttgcccctcctctgggtgttataacccaggagaaactatccccacctactccagggttgattcccaaacaccctttctctcagtcccccgtcctaaaagcacagaagcctgatcattctgaaccacctgctctgcagagctctgatccaggccattcctctggcattcctggaaatactcctcacttgtcgcccccatttttaaccactctcctcagagcagcacgagccttctctttaaatggtgatcttaaccatgttttctcttctgcctgaaactgaaacctttcggtagcttccctttgccttaaggataaagccctagttcttagacgtgacctacagtgtccttcaggatccaccctccagctttctctttgtgatgttctgctccacatccactccacaatcattaagccccagaattaaaagtgtggcttccattcactaaaaactctgtgtgtatgcttgcctctgggtttttgcaggtgctgttccttctgcctggagcacctttccagcctgcccccttccacaatgtaactctccttgcttctcaccctcaggccagatatcacagctagatggggttccatgccatcatggggctctcttaacatcatgcatactccaaggcatccatcatgcattgttgggtgttgcctatgtctattcttaaaaggaaggttccttaaaaatctgaattcaaggttctttgctgatcatagaactggctggacatatggaaaggatatgctaaatatgccttaaaaatatagatcatttcatgaatacgtaatgcagaccttttgatattttaaaatttattttccttagaaagagagcttggaggaaacatgaaatcaattaggcagctgtgacagtagcccagagcagagctcaaagcctgattttatggaaaatagaaaggaggggtgaatcagtgtaaaggctgtatcagcccactcaatggaacattattttaagatatatttaagacaacatatggtattaaacagttatactttacttaaataattgcttacatatgcttcaaaaaatcacctgattgtagaccaaattgtagaaggaaattttaaaaacacactaattttctatttaaaaaattttattaaaaattgcaaaatgcagaaatttgacaacttcagtttttatgataatgtgaaattgaaatcatagaagaacatgtataactagtaactaaactatgtaatcttttatgttacatataatacttactgggtataccatgtaaaaacaaaaaatatatatatataataaaggcattctctaaattctaaatgtttgttcagtgccatagagtaataatatagttcttcagttgtcttgcactgtaatgtaaaagaacagaggccaatttaatacataagtaatggctatgcaccaacagaaggctaatgatgtcattatgtaatgtacaaatgaagactttgcagcaactttaataggacaagccagactaggcttcagtcatctcagcagatggagtgatatgggcatgccgacctggcagcaccctgcacctgtctccctgcagcaagcagaagtcctgccggatctgatccttactcatgcaagccttcattggcagaaagtgtagtcatttcaaaagcacatggaaaaacacttccttaaattaagatttttaatttgttaatttatctcacggtgacctcttacattgattatgccttcaaatactacattgatgattgagttcattcaccgttcagaaagaaaatgtaatcatggcagagactaccgttcaaatgatggttcatgatgctcaaagtcaaagccaagtcaatggcagtacaactgtaatcacgaaaaatcatcttcttactccccaacccaattgtggcaacttcatcacttgaaattaatgttgtcagctttatttaattttatgggttatgcaccctctaaatacacaaaattgttttaaatttaagcctaacacactattataaactcgttaataaaattttaaaaaatttacgcactttagaatttggtttatgcttaatttggatgtttacttttatggcttatataggttagaaacatatggcacacacataaaatatacctacctacttatatatttatacacatttaaatatagtgctgttaaaagataattttcggaaagggtaaaatcatgactgcgtacatatataaaagttaacatgtgttcatgactttatttgagtcattaatgaatgagggaaccagacagatgttagaaccctttcaccagaaaagtcaaaacagcacaaacgtacctggaacaaaataattgaatcacaaaatggcagcaaagctggcttttccaaaggtggagagggaagtcaatagaacctgtctggccaaggcagagtttgcacacctacttgtacttgcaatttataagagatgcaaagattcagggctgcatcccactgcttggaaagggacgcttagtggcaatgcttaggtgttcacctaatttttctctacaataaaagtaattgaatgctggactgaagttcaatgaggaaattcttttttaaacttcaaatgagatccatacattattcaagtatgaataatttaatcccaagcacctaaagaagactgcttaaatatgaatatttctcagatgagttctttctgataagacattatatgtatttgttgtaccattacttttttctgagatgggggtctggctctgtcacccaggctgtagttcagtgacatgatcatagctcactgcagcctccaactcctggtctcaagtgattctgccactgtagcctcccaagtagctgggaccaggcatgcgccaccatgcccagctattttaaaaatatatattgaatttatacattcatatatgtagatatgtatacatatgcacatgtacatgattataagggacagtcctgcctgtagggaaaatgagagaaaacaatcagcctgagaagtcaggggttgaaaggaaaatgcatttctaaccataagcagagaggaaacccacacagaactgagaggttta

SEQ ID NO: 9757 - DNA, 823 bp, artificial
  synthetic oligonucleotide
actaatgtttcttgaattccactcaactcttctctctttccttgtcccttatcttcttgatgaagaacacctttgaatatttatttaagtagtagttttatagtctgtttatatgaactctgtgtctgaaaaaatgtccttattttatgttatctgttgcatgttaggttggcaattgctttccttctaacctggattgctataaatgagaagcccaccattagttgaattgtcatcccccggtaggtaatccagtgtttctctgtggtatcttaagaatttatcttcattctcaatggtttgcagccaactattatacgccatggagtggatttatatttatcttttcaaatcatagagtgtacttttgatacaaagatttcaattctgaatcatgttgaatattatttttctgaaaaaatacattggccatgatcttttcaaatgttgtttatttacaactccatccattctctagccacttatcttttatgaaactcctattaaagtaatgtgatagtgtctcactctggcccccaaatctcacagttcctcttttatatttttatatttctttttaaatcacttttaaaaaagaattattctgtttgtttgaatgttgtaccaatgtattcaaagaacattctttaaaaagttttctacagaagaacttttataataataaaatcatagtttcaacaaaagcaatctgccatgtgagttgatattaaaagatgatgtgatgaactacacagagctggcatggatataaagaaagaactggagaaaaataaggaaaatctctggcttgatagaatttcaa

SEQ ID NO: 9758 - DNA, 5708 bp, artificial
  synthetic oligonucleotide
gtgtgaagatttggtttggaagatggaccctgcttcaaggtctgggaggccatgtttttttcagactggttaaggatgacggttttatgttaactaaacattgggatcaagtgacagttgtttatgtccggtgcctagagtatcagttttcccatgattaaaataagcgatattttggtaaacattgataagttagttgcgcattttagttcagaaacccacagcgagtcagaaggcgctttgtgctgctgggcgcctctgagtgattccggggagtgcggcagttctccagccccaggagaccctgtgaaagaagcacaaacaatgctcacggcaaaactcacagtgtttattcttgacctgggtgtctgccttgaattcttgtcatttttcctatcgtggtggatgtagccggaatgctttaaagaaaacatgagagttttttctgcctgtttcccttgagcctggaaccgattatgaccccagatagcctgcacagggctctttcctttctggaacacctgcccaggctagaatatgggagtagggaggaggtgaggctctctcctgcccggtaaccttcccggccagctctccaagacgctgaaaccttccttcgggtctgttgaaactgcatccccagcaccatcatgtcggagcaagaagagaagggcatgtgtcccctttaggcttgactctttccaattagggacctgcctgttgttaggatttagagtccatgtgaatgtgcagtattgttcagtgctgcgagcatttttgcttgtctgaatttcctgatagaagggaatttggacaaaaagaagcttattgtacatggtgccattttattccttaaatcaataataacaaatactttatttatgtatttttagagatggggtcttgctctgttgccctgatcatagctcactgcagccttggctttctgggctcaagtgatccttctgcctcagcctcccaagtagctgggccgacaggcacaagtcagcatgtccagctttttttttttctttctttttttttttttttttaattttcaatttttttctagagattgggtcttgctgtgttgcctaggctggtcttgagcacctggactcaagcaatcttcctgcatcggcctcccaaagtgctgcgattacagttgtgagctactgttcctggccaacatatactttaatatggcaagaccatataaaataattttaagaggccaggtgtggtggctcatgccccccagcactttgggaggctgaggggggcagatcacgaggtcaggagatcgagaccattctagctaacacggtgaaaccccgtctctactaaaaatacaaaaaattagccaggcatggtggtgggcgcctatagtcccagctccttgggaggctgagacaggagaatggcgtgaaccatggaggtggagcttgcagtgagccaagattgcgccactgcactccagcctgggtgacagagcaagactccgtctcaaaaaaaaaaacaataattttaagaactggaggaaaattcagcaggactgagtcgtgatttcagtttctggtgcactgtgggtaattgggtaattgtcagcctggatgcttgtgctcctttagttgtcactgttaccttgtcatctatgtgaagatgagaaatgaagttgagtggagaactgtcgccaaagtctgccatgtaaaaatcggtagtgccaatgtgcaaaggtaattcccaggtgctataaaagtccaggtggcttcacagtttcagattgtatttcccgaaagcgtagagaattgatatccctgaataggaaattgacgtccctgccatttggttcatttggggaacagaataaacttgtgtccttgccttcagttcttttttcaacagaatcttatcaagcatttgaatcgtacacaactgtaatgccagctccatgttgataaaaactcaagaattcaaaattataaacttgaaaacagcaattgccaacttctgacagtagcaggagagtctggaggacctgttcagaggaagtcgggtactgtttccttttcttgtctaggtttgttcttgtccgatgggatcagagagattgagatggggcatgataggcggtgggttcaggagaaagggaagctttagaaatgaaggtagaaaagatgctttcttattggaacagtgttttcaacgttgagctctggaatgttgcagccaactaatggttctcatttgggacagttctgtcccccacctttgaagggggtttggtttaattcccaatttgattatgaagaaaataccagattcagcttgcattttcaagacacagtggttctatgtcaacttcagccatttccagggatctgtcttaggatacttcaaaaagcctaacctttgagatgcactcagctcataagttcgtgaaaataagaatgaataatcttccctgtccagtacatgacagaaattattgtagaccagatgagagcaaggagagatacttgttgatattacatgtcacgggatgctctgttaaattttatgggactctgagtgtaattcctttaagccagtagtctctaaatttgggggaaggacaggggacagaaatgacttgtttcagattttaattcccaaaagggtcttagtgagtttcatgccctctggcaggtgcacagcaagatttattgggatgcaggaagaaattatgaaaatgtccattaagaaaatctctaatacttgtaaaaaatatatttcttgtccatgaaatgcatgttacttgagtattttatatatttaataaattacatgagttaggagcaccttctgaaaacttttttgctgaaaaggatatatgatgaaagaaacatttatgatgtaggtccccaaaggctggaagagggggtgataccaacgtccctgcctgcaggtaggacacagttgtactcccctttcctctgacttcagctactaaggtatgtgtgcgtttgcacgcacatgtatgtgcgttaagtaactttgagatccaccagcttaaggactggacatcgttccagaggtacaggtattagtgatttgacttagggaagaaagaatatgcaataacagggaaccatgcacatactggatctattgtattttgcgtgttgtttttaaagctgaaaaaatgcgcttgtttcggaactagatgacagtacctgtttgcaggtccacaaggaaaccttggaacaatgctatgctttttaagcgttttatgactgcattgttttcataatcactgaattctgtttataaatcagctgatttcattgacggatgccctcagggctctggagaattaggcgttttgctgcagaaatggttcagaatttcaaagacatcaacgtgagattgtactggaattgagttgtgataaaagtcctagggtgctttaaatctttaaatctggttatttgtttgtttgttttttgaggcagagtctcactctgtcgcctaggctagagtgtagtggcgtgatctcagctcactgcaacctccgcctcctgggttcaagcaattctcctgcctcagcctcccgagttgctgggattacaggcgcctgccactgcacccggctaatttttgtatttttagtagagacggggttttgccatgttggccaggctggtctcgaactcctgacctcaggtgatccgcccaccttggtctcccaaagtggtgggattaccggcgtgagccactgtgacctgctgtttttgtttttgagacatatttcatctatcatggttattaagtgttttgtttttttgcatttctcattggtgttttttgtttgtttgtttgtttttttgagatggagtctggctctgtcgcccaggctggagtgctcagctcactgcaacgtctgcctcccaagtttaagcaattctcctgcctcagcatcccgagtagctgggattacaggtgcccaccaccaccacgcctggctaattgttttatttttagtagagatgtggtttcaccatgttggccaggctggtttcgaactcctgacctcaagtgatctgcctgcctcggcctcccaaagtgctggaattacaggcgtgaaccaccacgcctggcctcattaggttttttttttttttctgagttgctgctacactactggtgttacagagtgaataaacataaaaattatattcacaactcagaccacattgtgggctgtggaggtgagaaataggaatcatctctaaatttaaggtcttctggctgagctcatttgcttagaatggctgaaggtttggttttcatgagatgaaatgccaacctcaagtggttctgggtttccagaccagtttttagtttgtttaacttgagagaattgatatgtcagctttagtttttgtgtgtaatttttggtgtttgcatctgttttcttctttgtgaatattgaattcgcaacataactttgttatatgaaatgatgctcatacacttgcgcagtgcattagaaagcctgccaggagcagtacttgtagatttccgtgtaccagcaggatgcctaatgccgaccatgattaatgctcatcagaatctatgtagacctccatttgtcctttgataagctgaaatatttgtgtctactttttaaaaaacctgttgcttctctttatggtaatactcagaaggcactcactgtgaagagaggagaaacaggaagtagaattttttactatctagattgatgcacctatctcccctctccagagaccaatgcatttaggccccagtaagaaatttagttgtaatgaaccataaagcagatgcagagtatatttgggaatataccttatctgactccacagcccaacccctttaagaggaaagagatggcacaatatattttgctttaagccttagactggtcttgacttcatattggaaccactgaattgcttcagctgtgaactggaatcctctcctgtctttgttgttgagtgatgacactcttaattaatcatttgcttatttgccatccaaatcaccctatataatctttcagaagtgtatctcagagaatgaccctaagtcggctgacctctgaagcctgtaccagaattgactttatttcttaagcgcacacttcctgtgctttcaaggggcagctgtctaggtttagtttctgggagtttgaggcacagaggtatgtaggggaatgggaaggccaaatggtaaaagcccctgggacgtggaatctgtgagtacactaaccttgaaagagattatgaaaacaaactttagagcattgttgaagcaccatctacataatttatatcaatgaagacagtaacttattaggaagacaggattattaaaattaaccattttcatctttctacaaaaataaaaatcaaatcaattttagttcagataattgtatgtgaagctttataagtgaaaatttgaagttagcaaaattatataaccttagttaattatattagtgtactcaaactaaatatagaataagattagctcatggaaacattgcatttttatctcagtcagtactgctcatatccacccagtagttagtttctagttacgttttgtaattttttgaatatcctggacatggttttagaaaagttagttgaaacaagatattgtatgctttcattatttcc

SEQ ID NO: 9759 - DNA, 541 bp, artificial
  synthetic oligonucleotide
tgctttcgtgacacccagccttcagcccaggaggatggtggcagatcagacagctctggaaatgcagggcacaatgcgcagagggttgcaccacaacagcagtcactcggtgcccgcctggagcactgctctcatttccagagtccctgtatttctgatcttggctgctttaaaaaggaggtgtgggcctgggatcccagaagtattcctctgtgattctgtaccacagctttaccttaattgggggtgtagggggtggggagaaagaggaagacagatgaaagcagggaaatccttcttggagtcatagttaaaaggataaaataagagctttagtgtagcctccgtttccagcaatccattttattctttgtccacaaactgaatgaaaataagcagtcattcaaaaatgatatttacgtaacctacaaaaatctcaatcaaccaaggaaaaggtggaatggggcttaatacaatacagggctgtctccggagttccctcccttgatttcaggcttttggtgtaaagctcccgaaagaa

SEQ ID NO: 9760 - DNA, 1100 bp, artificial
  synthetic oligonucleotide
tatatatgtatataaaaattggtttttgctgtttgttgcggcatcacttgcagttacaaagaagtgaacatagtggttacagattgggttgtaaggctggacctggccgtatgatgggttactaggcacctgttaaaaatagtactgtggaagtggtatatttattggcatgtccatgtgtttacaatatattacaatggtgttactgtaatccccaggagaccagcagcccagctgggactctgagagctctaagatacgtccttggagtaaaccaagctgcaaggaggtctgttcacttctgtattgtttatccactcataaatttgatttacatagctggactttggtgttgtacagttatctcataatgagggttattttaagaagtgtctcaaggaaatgtgtcgtgtgtttactgaggatagcgttgtatgtagtccacaatttcctctttctgggagaaattttgcacatgtatcagaagtctaggagctgtgtttctgatatttgcatcttctttattgtttagatactgtgaatccagcatctaactatagttccttctttgaggtctaggaaacttggaattggattgacaattcccttccaagtgatttcaggttgtatccgactgcgaactttggataccgccttcctgtctcagcttcgtctcctttgtcctaccatgatcttctcttggccccagtttacccagtgaattactttatttttgctattttgtatgtgtttttggaagccacccccagttttttctcttcttttcctgggtggggagttagaagtgttgcagtggatgatggtgctgtggctttttggaggttggtttgcagtagcttttgagttctggtgtgttagtgtcatcttattctaatctagctgcttcctgttgaagtacatcaagacgaagtatatttctaaatttattacgatgaatactctatcaaaagcagctggtgcttaggccctaggtagagctttaagataaagttctttaatatcaatttagaaaaagaaagattcataatgattaatggagctcctgcatcactgaattttactggaataaaaaaaattag

SEQ ID NO: 9761 - DNA, 1018 bp, artificial
  synthetic oligonucleotide
ttggggccgcagagtggagctgggctccctttgaggaagtcatcagtgctgagagccctcctcacgggtgagagtccagtgggatgtgtctgagcagcctacgctgggcatgggccggggcacgctgtgtcccaagcatgctttaggggtcccagtggcaaaagcacatttgtggttgtttaatctctggaggtggaggatagccccagctcctgggtcagtcagctggcggaacagggtaggccaggggagacagcactccaccctgctgggcatcttattaaatgcagcccagtatattcaatgccggcatcactacttcatgggaaaggatgcagcgcttacagcaggtagtggggtagagtggctgtgtggggattttcaaaatggaggctaaagtgatgcactttggactcgctggaaagtgcctggacctctggtgagttcagcctgggaggtcagagcaccacaaaatttgcttgctgtggctgggtgcagtggctcacatctgtagtcctagcaggagctcagtagtccaagctcaggagtccgagaccagcctgggcaacatcctgtctccaccaaaacaaaaccaaaaacaaaaccaaactggcttggtgtggtagtgtgtgcctgtagtcccagctactcaggaggctgaggcaggaggattgcttgagcctaagagttcgaggctacaagtgagccatgatcataccactgcacttgagcctgggtgacagagtgagaccctgtctcaaatgaaaaaaaaaaaaaaaaaaaaaaaaagtacttgttgcctggccacaggaaggtctgtgtgttggtttgtttaccttcccgaacctttgctggggagactttttatgcccccatatgccccagattcactaacaagaaggaagtgttctgttctgtgtaggatgtgcagaaacagccttgaaaatgttaccaatcaccgaccttctgaaacgagcttctgtggatactgggaaagcactgggacaccattcccctc

SEQ ID NO: 9762 - DNA, 2199 bp, artificial
  synthetic oligonucleotide
ctagagagaatgacgttgttcctttgtaacacagaaaagcattcacctctcaatttagatgagccattttgaccccagttggttctgaaaatccttgttgacaaacaaaattggagaggaccatagcctgcctgcttttcccgaggcccggggaaagctttttcatatgatgttattataatgttaggtgtaacaataaatgaaagttttgtatggtctgattgggtaggacaggcctgaacacaggcaaacccatctgcacagcatgctcaattcagtcagtgtacaaaccctgtgtcatgggagcagagagaagggtctgcttccattccggaggatgacagaggcttaaggacggtgctggcgtttcagctgagcctttaagaagtggaattttatccagaggtgatcttcttggaatagagagaacaaacaggtcagggcatgcagacttgattacaggtgctctggggaccactggaatttttgttgaacagaggatgatgaaataaatcagtgttctagtgtgttacctttgggcagtggcgagatccgagtctccatagtgaacaaatcagtgcacagaccagggcagaagtgcaggggaacatggaacattcagggcctggagggtggtacccaggccaacactgccccctttttccagctcccatctctgtccacatagttgggccagtgtagacatctgggtcatatagggaggcattccagtggccccatgtggtttccatggagatcttcaggaaggggttttggggtgagagttggtatctcgtggcaaggacacactccctgggctaggtacatatgggtggttttcttgtcctacagattgcaaagatacaggggtagctgttctgctctgggcagcttctgtagagacaggatgtgtatttgcttgcctgctcctggaagccagtcactgaggcagacctctttactcgtccagaagcatgacttggggatgattatagttcaaggacataaggcctagtggtgtctttcatcagcgccccccattttacatttctgggatccccctttctcttttactctgatctggcctcccttcccacccctctggccactcaggtgaggagatgccagatcccaggtgggcaggaaggaatcccactgaatgagatccttggaattgcagcgtagcctggagctgtatgttcattttagatagaaatattgacactattgacactatttggccgggcgcagtggctcacacctgtagtcccagcactttgggaggcaaatcactttgaggccaggagttcaagaccagcctggccaacatggcgaaaccctgtatctactaaaaatacaaaaaaattagctgggcatggtggcacacatctggaatcccagctactcgggaggctgaggcacaagaatcctttgaaaccgggaggcggaggttgcagtgagccgagattgcgccactgcactccagcctgggcaacaggtcgagactgtgtcttgagaaaacaaaaagaaagaaatattgacactatctgtccgcaaaaggtcaaaggcataattacaatatgattttgtttccatttttctttttcttcttatttcatgcaaatgctgtctttttgagagaagtggttataagcacagcgatattctatgctatgtacagctctcatatatagaactctctagaatggctcaagttaccattaagcctcaggtgatatcaaggttataaaatgtaaaatgaatgatcatgatcattaagtagaaatcctggctgtgtcttccaagttctttttctttctttcttcctttttttttttggagataggtactatctgcatttcagcttagcttgccgccagtgttctggtttcttgaccatgctgagtaattttcagccacaccttgtatcccttagaagcccttcttgattctgaggtacggggctcagaaagctttgtcgtgggaggttgtaaattaggaaacatgaaaatcagatcaacaacagtggctggtcctggctgcagggctcatctgcctggagtagcttgaagttgaatgttaatatatacttttaaattgcagttgtttaattaggtaaagtgcacaggtgactttctcacactaaatggatgatgagtattgggaagagttgactaaaatttctctatcttttgccca

SEQ ID NO: 9763 - DNA, 246 bp, artificial
  synthetic oligonucleotide
atcccattgtatagtaacttatcacaggccctgaatttacctaaagccaccaaatatttttaaatgtgcaattgtctttgtacctccaatatggtcattgcagtttggtgcgtaatttccctatcaaacacaatgtgtagcagaaatgaaagcaatatactgtattaatttaacctaagatgataatgatttaatatagcacctccatgtaagaggagtatagaagatacttttggttacttagcc

SEQ ID NO: 9764 - DNA, 172 bp, artificial
  synthetic oligonucleotide
cgccgcctctcgcttgcagagctccacctgaagcagaagggggataacgaaggaggtctctataccatggctcgtacaaggtggactgcccgcaaatctaccggtggtatagcacccaggaagcaactggctacaaaagccacttgtaagagtgcgccctctactggagggg

SEQ ID NO: 9765 - DNA, 1107 bp, artificial
  synthetic oligonucleotide
atataaatggaaccattaaatcattaaagcattatccaaataaaaaatattatttgcattatcatcttttttaaatgaatgattttaagcattaagtcaatgtttgcaactatattatcttcattttgcctcacttggaaataaaaatgatgattttaaagaacgtgttaattaaatattagcccaaacaaacctcaataatcttgttcacaagtttcataatttcccattccattaaatcaaatttaaaattgttaaaagctgtcttttcccactagtaaacaagatatatagtgctagttttgagactttgagactaaagtttacttatttagtctgttttacaaaaagcggtgccactcaaagagagtactaaatctgctcaactttcccttggtggatatgataaatcttagtttatgaaaatgtgaggattatcagaattatctaacataaaatatatgatgctttatctttatacttatataaattattcatatatattacacagtaatatataatacataagattatatatgatagtgatttcattgataatatataagtaatatagtattcatataagtaatatttatatacagatgtacctgttataactagagacataaccagacattgataatttgtgtttgcctttaaaggaatagatcattagcatgaaattgtgggaaatggcattgtaaatatcttggtttgtatttcctcagatgcagatcttgaaatcaggattgaaatccaagtaccatatttgctatgtgatctcaattaacagatgtagggaagacaggatgtgagatagggaaggggaagaaatcgataaagggtactttatccaggcatctgccacagtgagcaactggaaaggaatcccgtggaagatctctgggaaatggcgtggaacacatacctcagagttttcacacctgagaggttaagaaagtttggttacatatacagtaaccgccactattccaatcattgattgaagagtgctctcagggattgttcaaactctagcaccagtagagaagccttctggggtttctgaacaatcttgagccaaagaggtacaaaattgatctatga

SEQ ID NO: 9766 - DNA, 1795 bp, artificial
  synthetic oligonucleotide
ctcccaaaatggattgtacaaatgcttagttttaggagacaactttccccttccagttccatataaaaatagtttgaaacagagaaaacctccttttttttttttttttttttgagacagggtctcactctgtcgcctagactggagtgcagtggtgcgttctcggctcactgcaacctccgccttccaggcccaagcgattctcctgcctcagcctcccaagtagctgagattacaggcatgcgccaccacgtccggctaatttttatattttcagtggagacggggtttcaccatgttggccaggctggtcttgaactcctgacttcaaatgattcacccgccttggcctcccaaagtgctgggattacaagcgtgagccaccgctcctggctgagaaaacgtccattttaaaaagtcaaacattccttccttttcttcctcctcccctttctcaatctttccattccccttcagcctaacatcctcatcatatacactaatctatacttagagatgcaaataccgtatgtagttgagatatgcatgtatttctacttaactattaaagccttatggaaatggcagttgttcaaataaagcttaaaaaatgagaaactaattttaacttcagaagttttgaaccttctgtagggatcttccagtatggctataatacttttgatcataagaatatccattggtacaaaataaagatgtaattagccactgggtagaagaggttgagacaaattggaattatgtgaatatattttatgtactgtatgtatcccccttgtctggaactcaaatatattggatatgagaacctaagtgagaggaacataatctgttttgagaaaaatcatgataaactgacattctacattgtatttgtttgtttggttggtttttttttttttttttgagacagagcttagctctgtcacgcaggctggtgtgcagtgacgcgatcttggctcactgcaacctttgcctcccgggttcaagcgattctcctgcctcagcctcccgagtaactgggattacaggtgcccgacacgacgcccagctaatttttgtatttttagtagatatggggtttcactgtgttggccaggctggtctcgaactcctgacctcgtgatctgcccgccttagcctctcaaagtgctgggattacaagcatgagccaccgcgcccagcctctacattgtgttttaaagctgatctgtgagagtcttgatattttatttggaaaattatattcccaagaagaaatatgttttttgttatgttcctaatttggagataatctagactagtctttttaagtaaatggattcataagagctaagtcagacaattattatctgcttgtttggtaaatcttttacaataaatatagctgacagctttaagagcataaatgcaggtttctaagataagtatttaaataaatatagtctctaataatatacattttaatttcaaagttataagtcaacagctcttagtaatactgtaacaaaccttttattattggagaaaatttctgttcttttttagcaaatccttaaaaaaccactcgactttatgaaatcaatatatatttaacttcagttgtatttgaacaggtatgtaaatatttattaatctctgttttgctttttcttcttacagtatataatagttagcactgacttgccttctcaaagcacctcccattttcaattgtctctctttctctgatgattttcatgaacctctaagacctgtggattccacctcagtt

SEQ ID NO: 9767 - DNA, 9960 bp, artificial
  synthetic oligonucleotide
attataaacaattatctccatttccaggaacactgggggaaaatgacaagcagaaagaccctgaaacctacaggaaagagatagttcaagaaaaaggtaagattgctctaagtgctcttaagaggatattggattccaagtacatctatctagggatttccaatagtaaaagcttaagagaaaagaaaatgaaagtcttggagagagaatgagaatggtggaaaggctatttcactctttaagaatggtaaggaaaatagtttcttctgacaggataaagtccagctatagataattatatttatttctgaggtcagtctttttgacacattatttttcttcattctcattccatgtgagagagagaaaactagaattctcttttttccaacttttaagttcaaggatacatgtataggatgcgcaggtttgttatataggtaaacgtgtgccatggtgctttgctgcatagatcgtctcatcacctaggtattaagcccagcatccattaggtattattcctgatgatctccctcctcccatcccctaccctacaacaggccccagtgtgtgtgtctgtgtgttctcatcattcagctcccgctaataggtgagaacatgtggtatatggttttctgtttcagcgttagtttgctgaggctactgacttccagctccatccatatccctgaaaaaacaagatctcatttctttttatggttgcatagtattacatggagcatacatactacattttctttatctggtctaccattggtgagcatttaggttgattccatgtctttgctattgtgaatagtgctgcaatgaacatacatgtgcatgtatctttattatacaatgatttatattcctttgggtatatacccagtaatgggattgttgggacaaatgttatttcttcttctaggtcttcgaggaactgccacactgtcttccacaatggttgaactaatttacactaccaccaatggtgtaaaagcattcatttttcttcacaacctcgccagtgtctgttgatttttgacttttcaataattgttattctgactggtgtgagatggtatctcattgtggttttgatttgcatttctctaatggtcagtgatgttgagctttttttcatatgtttgttggccagatataggtcttctcttgagaagtgtctgttcatgtcttttccccactttttgatggggttgtttgttgttttcttgtaaatttgtttaagttcctcgtagactctggatgttagacctttgttagatggatagattgcaaaaattttctctcgttctgtaggttgtctgtttactgatgatagtttcttttgctgtgcagaggctctttagtttaagtagatttcatttgtcagcttttgcttttgttgcaattgctattgcttttggtgactttgtcatgaaatctttgcctgtgcctatgtactaaatggtattgcctagatttccttctagggtttttatagttttgggttttacatttaagttttcaatctatcttgagttgacctttatataggtgtagggaaggggtccagtttcaattttctgcatatggctagccagttctcccagcaacatttattaaacaaggaatcctttctccattgcgtgcttttgtcaggtttgtcaaagatcagatagttgtggatgtgcagcctcatttctgagttctctattctgttctaatggtctatgtgtctgattttgtgccagtactgtgctgttttgactcaaatagccttgtagtatagtttgcagttaggtagtgtgatgtctccagcttttttctttttgcttaggattgtcttgactatttgggtacatttttggttccatatgaattttaacatagtttttcctaattcagtaaagaatgtcaatggtaatttaatgggaatagcattgaatctataaattgcttttggtagtatagtcattttgacgatattgattcttcctatacatgtgcatggaatgtttctccatttgtttgtgtcatctctgatttctttgagcacagtggtttgtagttcttcccttgttagctgtgttgctaggtattctattctttttgcagcaattgtgaatgggagctcattcatgattggttctctacttgccttttgttggtgtataggaaaactagtgattttcacacatcaaatttgtatcccgagatgttgctgaagttgcttattagcttaagaagcttttgggctgagtcaatggggttttctagctatagcctcatgttatctgccaacaaagatagtttgacttcctcttttcctattgaataccctatatttctttctcttgccttattgccctggacagaacctccaatactatgttgaatagaagtggtgagagagggcatccttgttttgagccgattttcaaggggaatgcttccagcttttgcccattcagtataatattggctctgggtttttcatatatggttcttattattttgaggtatgttccttcaatacctagattattgatagttttaaacatgaagggatgttgaattttattgatggccttttctgcatctattgagaaaatcatatgggttttgtctttagcactgtttatgtgataaatcacatttattgatttgcatatgttgaaccaactttgcattctggggatgaagtgtgcttgatcattgtagataagcttttagagtcctgctggattcagtttgccagtattttgttcggaatttttgccctgatgctcatcatggatattggcctgaagtgttttgttttgtttttttgtttgtttgttttttgctgtatctctgccaggttttggtatcaggatgatgctagccttacagaatgagttagggaagaggctctccatttcatttgttttgaatagtgtcagtagaaatggtaccagttcttctttgtacccctggtagaattcaggtgtgaatctgtctggttctgggcttttttttttttttggttggtaggctatttattactgcctcaattttagaactcattattggtctattcggggattcaattttttctttgttcagtcttgggaaggtgtatgtgtccaggaatttatccatttcttctagattttctagtttatgtgcatagagatgtttatagtattctctgatagttatttctatttctgtggggtcattggtgatatccccctcatcatttctgattgtgtttatttgaatcttctctcttttcttttttattagtctatctagcagtctatctattttattaattttttcaaaacaatagctcctggatttgttgattttttgaagggtttttaatgtctctatctccttcagatcagttttgatcttagttatttctcgtcctctgctagtttttgggtttgtttgcacttggttctcttgttcttttagttgtcacgttaggttgttaacttgagatttttctaactttttgatgtgggcatttagtgctataaattccctttttaagactgctttagctgcatcccaaagattctcatatgttatatttttgttctcattagtttcaaagaacttcttgatttctgccttaatctcattatttacccaagagtcattcaggagcatgttgttcaatttccatgtagttgtgtggttttcagtgaatttcttaatcttgagttctaatttgattgtgctgtcatctgagagactgttattatttcagttcctttgcatttgctgaggagtgttttacttccgattatgtaattaattttagagtaagtgccatgtggtaatgagaagattgtatattatgttgtttttgggtggagagttctgttgatatctatcagttccacctgatccagagttgagttcaggtcctgatgtcttttttaatattctatcttgatgacctgtcccatagtgtcagtagattgttaaaatttcccactattgttgtatgggagtataagtccttttgaaggtctctaagaacttgctttatgaatctgggtgctcctgtattgggtgcatatgtatttaggatgattagctcttcttgttgaatagaaccatttaccattatgtaatgcccttcattgtcttttttgatttttattggtttaaactctattttatcagaaactaggattgtaaccctacttctttcttttttccatttgcttggtaaattttcctccatccctttattttgagcctgtgtatgcctttgcctgtatgatgagtctcttaatgacagcatacccatgggtcttgattcttaaaccagcttgccattctgtgacttttaattggggcatttggcccatttacacttaaagttagtatggttatgtgtgaatttgattctgttatcatgttgctagctggttattttgcagagttgtttatgtggttgcttcatagtgtcactggtctgtgtaattcagtgtgtatttttagtggctgataatggttattcctttccatagttagtgctttctttgggagcccttgcaaggcgagaccaatggtgacaaattccctcaacatttgcttgtctgaaaaggatctcgtttctccttcgcttttgaagttcagtttgaccagatataaaattctggattggaaatacttttttttctttaagaatgttgaatattggcccccaatctcttctggcttatagggtttctgctgagaagttcactcttagtctgatgggcttccctttgtaggttacctggcctttctctttggctgccctcaacattttttctttcattttgaccttggagaatctgatgattatgtatcttggagttgttcttctcatggagtatcttaccaggcttctccgcatttcctgaattttacttcatggttggattctcagggaatcattttattaccataattttaacattactgggctaagaaaagtttcatgtttgccttctatactatatacactggcctggtgatgtgagacctgattaaaatcaggtgatatggcctgtcttgctaggttggggaagttctcctagatgatatcctgaagtatgttttccaacttggttccattctccccatctctttcaggtaccccaatcactcagaggcttgttctttttacataattccatattttttggaggtttcattcattctttttaattttttctctattcttgtctgcctgtcttatttcataaagatagtcttcaagctctgagattctttcctctgcttggtctattctgctattaatacttgtgattgcattgtgaagctcttgtgtgtatttcagctctaacaagttggttatgttcttctctaaactggtgattttggctgtcatctcctgtactagaaaactagaattcttaaggcagagtggactttaagacccacgttttgtatgagggaaggtagtgtggagaaatattgcataagaacagaacttgaacccaattatatgggggaaaataaaaatgaaaagaaaatgtctgtgataacccagggacttagactggtgactggattgcatggtctttcaccataatggagtttagaggagaatggacatgatcatggggaaaaatggcctttcatttgagacactcaggtttttagatgcctgactttaaaagtgtagaaatttagagtctgacacaaagtgttctgcaataacatagttcctcatcgagtttgtgacagaacttggaaaaccagcataatattttagtcaggtctcatatcaccaggtgagtgtatacagtatagaaggcaaacacgtcttgggagggtgtatgtgtccaggaatttatccatttcttctagattttctagtttatttccgtagaggtgtttatagtattctctgatggtagtttgtatttttgtgggatcagtggtgatataaccactttatcattttttattgtgtctatttgattcttctctcttttcttctttattagtcttgctagtggtctatcaattttgttgatcttttcaaaaaaccagcttctggattcattgattttttgaagggtttttcgtgtctctatctccttcagttctgctctgatcttaattatttcttgccttctgctagcttttgaatgtgtttactcttgcttctctagttcttttaattgtgatgttagggtgactactttagatctaccagaggtacaaggaggagctggtaccattccttatgaaactattccaatcaatagaaaaagagggaatcctccctaactcattttatgaggccagcatcatcctgataccaaagcctggcagagacacaacaaaaaaagagaattttagaccaatatccctgatgaacatcgatgcaaaaatcctcaataaaacactggcaaaccgaatccagcagcacatcaaaaagcttatccaccatgatcaagtgggcttcatccctgggatgcaaggctggttcaacatacacaaatcaataaacataatccagcacataaacagaaccaaagacaaaaaccacatgattatctcaatagatgcagaaaaggcctttgacaaaattccacagctcttcatgctaaaaactctcaataaattaggtactgatgggacatatctcaaaataataagagctatttatgacaaacccacagccaatatcatactgaatgggcaaaaactggaagcattccctttgaaaactggcacaagacagggatgcatgccctctctcaccactcctattcaacatagtgttggaagttctggccagggcaatcaggcagaagaaagaaataaagtgtattcaattaggaaaagaggaagtcaaattgtccctgtttgcagatgacatgattgtatatttagaaaaccccatcatctcagcccaaaatctccttaagctgataagcaacttcaacaaagtctcaggatacaaaaacaatgtgcaaaaatcacaagcattcctatacaccaataacagacaaacagagagccaaatcatgagtgaactcccattcacaattgcttcaaagagaataaaatacctatgaatccaacttacaagggacgtgaaggatctcttcaaggagaactacaaaccactgctcaacaaaataaaagaggacacaaacaaatggaagaacattccatgttcatggataggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcatgctgcctgacttcaaactacactacaaggctacagtaaccaaaacagcatggtactggtaccaaaacagagatatagatcaatggaacagaacagagccctcagaaataataccagacatctacaaccatctgatctttgacaaacctgataaaaacaagaaatggggaaaggattccctgtttaataaacggtgctgggaaaactggctagccatatgtagaaagctgaaactggatcctttccttacaccttacacaaaaattaattcaagatggattaaagacttaaatattagacctaaaaccataaaaaccctagaagaaaacctaggcaataccattcaggacataggcatgggcaaggacttcatgtctaaaacatcaaaagcaatggcaacaaaagccaaaattgacaaatgggatctaattaaactacagagcttctacacagcaaaagaaaccaccatcaaagtgaacaggcaacctacagaatgggaaaaaatttttgcaatctactcatctgacaaagggctaatatccagaatctacaaagaactcaaacaaatttacaagaaaaaaacaaacaaccccatcaaaaagtgggcaaaggatatgaacagacacttctcgaaggaagacatttaggcagccaacagacacatgaaaaaatgttcatcatcactggccatcagagaaatgcaaatcaaaaccacaatgagataccatctcacaccagtttgaatggcgatcattaaaaattcagaaaacaacaggtgctggagaggatgtggagaaataggaacacttttacactgttggtgggagtgtaaactagttcaaccattgtggaagacagtgtggcgattccacaaggatctagaactagaaataccatttgacccagccatcccattactcggtatatacccaggattataaatcatgctgctatagacacatgcatacgtatgtttattgcggcactattcacaatagcaaagacttggaaccaacccaaatgtccatcaatgatagactggattaagaaaatgtggcacatatacaccatggaatactatgcagccataaaaacggatgagttcatgtcgtttgtagggacatggatgaagctggaaaccatcattctcagcaaactattgcaaggacaaaaaaccaaacaccgcatgttctcactcatagatgggaattgaacaatcagaacacatggacacaggaaggggaacatcacacaccggggcctgttgtggggtggggggggaggggggaggggggagggatagcattaggagatatacctaatgttaaatgacgagttaatgggtgcagcacaccaacatggcacatgtatacacatgtaacaaacctacacgttgtgcacacgtaccctagaacttaaagtataaaaataaaaaaaaactaaaaaaaaaaagaagaattaatttgttctttagttcaaagactttcttacagacaagagcgcagtcatacatttgatatcagttcctactgttttctgaaaattatatagcatattatgatttaagatataaaaggggagactgctccttaggacttgcctggacatgagatctttggcatagacttggtacctaggcttatggtgaacctagaaatgtggaggtgccccgaacaaaaggtagcatggaatgaataagcaaagtctttgggaggtgaggatttttcttggccctctagttgccaggttcccaggtttaaccccccgtgttcttagtttcagagcctcagttgaatggggtagagatgctttcccagaggcccagaataccgactgtctttgagaggagaagttgtactgtgtcagtccctacgtcattaggatgtgtgtgtcatctgggtggtgttttaatttaacactccattgtacacaatagcaataaataataaataaaatctgttctgcttaagcaaaaaaagaaggcaaacatgaaacttttcttaatttagtaatgttagaactatggtaataaaatgattctctgagaatccaaccatgaagttaatgaacacaaatgaattaaattataaaaagtaagagaaatttattgttggagagaaaaatgtcttcaatttggtcttggagagatgaacgtctccagtttgttaagacttcactcaacatgagtgaaaaatggagtcaattgcaaagaggtatacttagtggagaaaatatagaaatggaagattgcacatgcaaaaatgcattggtgtcacccacgcaagcattttgcagatgaaaaatgttccagttcctggatccaattccaatcatattcatatggcaagaaaggaaattttaagcaaagaagatatgttctcataattaaggcctcatagcccccaagtaaactgatataatgtttttcctatgtactgagagagggtgtcctagtcatttcaattttaaatagtctagcctttgggagaattattttggattgtgaaataagaagtttgtattctggtctttgtagcaatttctgca

SEQ ID NO: 9768 - DNA, 610 bp, artificial
  synthetic oligonucleotide
ctaataattttcatattatataaactaagaataaatagatcattgcataaaaccagaaaataatttggcagaaaatttttgccctagaatagacagagttgtgcttggtcagaagagtggtggagaattgatctgaatgggtaaattgtgtgagctgagtcggaggtggactagaggccagagtagctattgtcctaattactcagtgaacttcatgaaatttgtctgtaaataacatacttatcaccctcacagacctctctgcacaaatgctttcacatgaatttgagctctcatatccctttctaggaggattttatggatgtatttggcatgtctgctgcagtgtgaagctaatttaccttcaggaatatgttctcaatacaggccacagcaggcaggcttcaggtacaccccgttcactgccatatcagaggctgattgctgtgcagagagtttcatgaaaattattttattttgtatttctagatttgcccctgaaatagtttttatcattgtattgatgatcttaatcaaactacaacagaaattctgaaagtaattaggcttaagtaaaacatagatgcatacataccaccagccaaactca

SEQ ID NO: 9769 - DNA, 1369 bp, artificial
  synthetic oligonucleotide
aaaaacaggtggtgagttggtttggactccatggctgagctgctgtttgctaaccattatactttatttagcatttcaaatgttgaacttttttctaggcaaagatcttttaaactacaaaacacacaatgaagttaatttaataaatgaataatacaggagtgcaaagtgatgcttaaccaatatagcgagagaaaattccaaaaaattcctaatcgcatattgctacatttcctcaatatagcaattcttcatttcatttgaaaaaccagtaaaatgctatagtagaaagcaccaggagaataaaagtaaaagggactagaacctaattagaaaaagaacctcctatagcacaggaaatacttctaaaaagtagataaacataatcagttctggattttcttctaaatgtcctatgtttattttcagcactgaggttgtggctaatgacaaagttaccctagatgtaaagtcaacaaggagaatcatcagcattaccactgttgtgatatttctacctttcctttggtccacaaccagagatatgactgctcaaacagaaaagctattttattttccaaaagaaactagaaatgggccatgactgccactgttctggccaaaacctggggcttagactggattattgagactatatccctggcgaatggtgccaagttttagaattgttgtcattatatccatttggaatgattcactcaggccagttgcccagcaccaaaactttaaattgctgatcagtttaacctcgatcaggaagctgaaaaagtggttcgatatggctatcatagtcaaggaggtctgaggtgcatttcaaggttcagtgtgggtactttggagctgcaaacagggcctgtggcatcatatctctttcagtaaacaactagaatccattgtccaaataatagtgccagcctaagaggtgaactaaaatcaaggactatgtaaatcagccagttaccatttccctctctcttactgaacaagactaagatatggggagtaaaaaaaagtgaaaaatattttatagacacctactaatggctattaaaataataggctgggctttacattgacacagttagacagatatttacttaccatccgaagtccaatactagatttagcaagaacatatacataagacttggacaattttatagtaatattataagagaccagaaaacttgttctaccctgacttttccaccaaaagatttgcatgccacaaatacctgctaacctacactcagtgtttgcaaaacaaattaaaatttcataaaattctctgtttccagcaccatttcttcaaaaaagtcatgcattttaagttttcacaatcagttaa

SEQ ID NO: 9770 - DNA, 1905 bp, artificial
  synthetic oligonucleotide
gctcttagagaggaatgcctgttttcattaaagctgtaacatagctgtggggattggaggttttccctgtggacacaatcatcttataagctacaaaatactggtatttacactgacaataatgtatcagtcctgttcaatgacataactgtccttccctttgctgccaacacatcaggccccaagcctcccttactgtcatgatcaataatgcacccctgtcatgatcagtagtgacccagcagcaatttaaaacctgctggtgtttctacctcaaatcttgcctggctgcctggctgcctggctaacacttttgccccaaatttttctggtttaatgagaagtttgtttgacaaagaacctgccaactgtagctcaggttgctttaccagtctcacttcaaattgcatattccttggtatatagcaccatctgtatcatgctgctggcctgtttgcatttggccaagtctgggcctaggtcagggaatttctgtcaatcattcactgccatgagatagaggagtctgcatgttaaacttcacactgcatctagctggaaaagagatttatagcctttggctccagaaccttagagcaactatcccaatcaatattatagtctaaaattttgacctaaagctattttttcaaggttttgtacccagcccacagcttctctttaattaagttgggctctcttacacattttttaaaaaaatcaaaggaccaattaatgggtctttaccaccaatatatataactagttcctacctctccaaagcttcaactctctctctcatacaaacatgcacacatacacagttgcactattaattaaactacattcacaaaatgtattaatgtgcctttctcccaagctaaactgtgtacttctaatagatagaaaatgagtcttatgcatgtatgttccctgccttcttgggtctagcacatgacctggaacaaactcgtttcttgactactctctttgaatgattaaatccataaacacatgtgttaattcctttgaaatctgtgttactaaggtaaaagaggtgttcattaattatttccaagctcaaacatttgtttgaagactaaagtaggaggaagacaagcatcaacaaattcagagctcctttaaacgggacttcaatggcaaataaacatgttctttcttttgacagttatgaagtgaagaaaggtcttgactgctcagtttcatgtagatctgaatatacacatctgggttgaattttcccaagtgactatagccatgaaagtgttaaatcatattcattaatgaattcatataaaggagactcatgctcttaatcatcctgatattaggaagataaaatttggaattattattggaaatggatgaaagtttcaattgggtataatggaaagtaatgcagagcagcaatgagctctgaaatcacgcatttacagcctataacttgaaatcttgatatgtttaagacgtaacaacagcttgtaaaaactcttgaatactttctgtacttctcttttttaagcctatgaaagtgtaaacttgataagttagggaatatggatcttttaataatgaacacacactcatagtgggtatccaaaaacatattattgattgttttatatatagattggagaaataaaagtaatgagagtagacatgctagaatatttcatatatccatgaggtagtaactggataagacctatcctcttatcatgagttgctgtagcactggacacattctttgagacagctgtttccaggcactgagcaaagctgaaaaaaaaaaaaaaaaaaaacctttgatacttaagagagggaaacacatgggataagtcatttttcaacctggtttctgtctgggggtagttttcaggatgc

SEQ ID NO: 9771 - DNA, 137 bp, artificial
  synthetic oligonucleotide
tcttcttcttcaagccaaatgtccctaaaaccttcagtcaatcttcataaagcctgatgttcagattcctcaaaattttgagcactctcctatgaatgttctctaaaagtgtccttaaaacgtggcaaccaaagtaa

SEQ ID NO: 9772 - DNA, 296 bp, artificial
  synthetic oligonucleotide
caaaatttctatttgtccattaaagttgaaaacaaatttatccattgaaattaaaatatattgctggttatatattctcaatatctcaataattaaagtcaaattaacacaaatattaagtcaataaaagtagtacagttgaaaaataaaaagaaaattccttgaggagaaaagtgacaccatatactatgctcacttgtcttggtttctttgtcatgtgaacaatgatctgaagattcttatactttactagctttctactctcttcaaaattaaaaagaaagtgtctaaagttt

SEQ ID NO: 9773 - DNA, 383 bp, artificial
  synthetic oligonucleotide
atagaaacttctcatggtaatgcatccacagtgaaaaagccatgatgaaacttcaggtttctttttccaccttcttaccttataagataatatccttaaaagtacaagcccaggaagggcatggtctttgggctcagattctttgggtttgagtcatgattctaacacttcatatttacaacctttgtagttttatggccatctataaataacaataatcgaaaaagtcaccagagttctgcacatagaaaacaatatatcagtttaattgctgataaaacctgggctggagaatatgaattagatatgtggcaataatgagcttcatgatactcctgaccccaccaatttagatattggcacagtctactgcaggcaaagct

SEQ ID NO: 9774 - DNA, 768 bp, artificial
  synthetic oligonucleotide
tatattattatatataaaaccttttcatgctgcaaacactacaatatatttctgcaatatcaactaagaattttattctttttctatgcttacattttagaaaataacagtgttttaagtcaacaacatacatggatggtaatatttatgctaaatatggcataacaaccaaataactccttttatttagattcccatatactataaaaacttacaatgcatctacaatttaataaagtatgtgttatcaaacaatactataaaatgaataattgtagtagaaaccaaggttttacccccctctttttgagaattatgctttacatcagtcctccttccattagtctgttagttaaaaagcatattgtcactgcaaaattaattgtaatgtttcctatgcagacatagtgcttaatagagcccactgtctcaatagaaaaggaatctgtctagtttcagccaaatttatttagagtcagataaatttgattaaacataaaacaagtatccatattgaacacctcagttacctaatcctttacagtctagtccattattaacagtattaagatcataagggattaataaagtttctacagaagggaacattttcccttgtctgatttcagtaaaggagcatatagctttgataaaatgaaatcatcatcatcattttctaaaatattctttatgttttatgtttcttgggcttactgtgctgattaagtggagtgataacatattgcactggtaccttatcactccact

SEQ ID NO: 9775 - DNA, 985 bp, artificial
  synthetic oligonucleotide
cttctctcttatgtacaaatttctcactccatttttctccaatgggaatttaaatttggaaccactctgaagctaatgtaatcataccagatacataaatatttcaatatgtatagcaattgattttgttacagtctttgataaaagagatacagtgtatagacacaattttaatggtttcctgcaattggaaagatacttggtatattcatcaattagtatcctttttatacttctattagaaaggctatgtttttgtttaagtacccaagattccaaaagtgaatttgtatctatgaatacagtttaatgtgaacaattgaaacgcgcatgcaaaactcaaatgaattgtatacctggcaggcaggatgaattgatagcatgttatttttagaaatctgagtgtatgtatgcataattctagtttttgaagttatctgagagtctttccatatcatattatacccaaaaaattaagtgtcatcatctaatggtttgaaacaaaagaaatttataagtaacttataattctttccatcacttttggatattaattaattcaaaacacatttataaaacttcttcctagtacaaggaaatattcaaaactctatgagaatataaacacatagaagatgtggtttgcggcatccaggagtatataatctagtagcggagataatataatttttaaagttatatttcaaataatatagactcagttacctcatctgacaagtgagaatggtaatatattttttgccatagtttttataaaaccaattatatgtatattatctttattgtctttattatcattatcattcactataaaagataatgaatatatgcaaattaatttttcagtggtagaacttgatttctagatgtcatgaattagaactctactcttttccatttctcaatcagagtctatattttcaactttcaaaattgcacaccacatttctacaatgtgagcccc

SEQ ID NO: 9776 - DNA, 1833 bp, artificial
  synthetic oligonucleotide
ataatatttaaagattagaaatatggtacacttgttttctaaagatcagctccatcttatcaaactggaataacatctgaattaaaataatgtgacattgtcatcaaagctctgattattgctgaagcatgtgataggtaggactggccaaaaattaatacattagaaaagttaaataaaaaataatatatatttccttgatatgtttaatcaaaaacatggagaaaataattgtaataaaaatgtctacatccttaaaggcatgttcacccctaactctcagttacgaacatctagattaaatttcattaaaagtcaattatccatattaaacatttaatctaaacgttgcgccccattagaatacatcaaaagcttacattttactaaaagaaagtgactacaatgaatgaacatataactttatagcaaaggttataatttttgaatgtttgactttagttgttaacatttttaaagacgttctaattttttacgaagcattataattaagcaaaatatccagttttttcatagtttcagttttcaaactgtggctttggtaaggtaagttggaaaacatcttagttttaatggcccaaaaggggagactttgatgtatagtatagattcaagtgcttatctcatggatcatgctttcattttactaaaaatataatagactaaaactttacatagggagaaatcgcagagaataagaatcaaaggagtaattaaaaattgagggttttgggaggctgaggcaggagaatcacttgaacatgggaggtggaggttgcagtgacccgagatcgtgccattgcactctagcctgggtgacagagcgagactccgtctcaagaaaaaaaaaaaaaattgaggttttacgtatttgagacctaatgaccaattgtttacttttgtcaacagtaattttactgctaagtaatttaagtaattttactgccagtttcagcaggaatacaatttcctaacatagatatttaatattttattcaatattttaatatattaatctttagtagaatatatgcttcaattttgtgaggatatgtgtttattttcttgtacagtgtaaactaaacaacgcataaagagaacacaggtaactagattaagaacaattattttctgctctttgtattagaacactcattttctgttcttagtaatctagcagcatcagcatctcctaaaaaatctgttaaaaatgcagaggttggggccccacttcagaaggactgaatcagaaactctgggggtggcatccagcaagctgtggtttaaccagccctccaggtgaatctgatgcccactcaaggaagagtgagaaccactgttctaatctatcgtcttccaagagtgtgtgggaagatcaaagaaaaatcaggtcatggggctttgcggagaacaatcaaacaaatacataaatcaaggactctataagcataatttaataaatagacggatgattgtttttaacttatttttcaatttcctccttagtttgtacatgcatttagagataatctcagcaatgtcagcgagcttggtggcatagttcaagctgtgaaggttcaataaataggtcggtaaacattgcaaatcaacacagcttttgatgaaatgtcaggcaagacagggcttagctatattcggctcagcttgaactcataaaccatcaactggcctctgtacttccaggacaatctgatgaataaaatacagatataaaattaaaaaatatatttataaagagattagtaaaacagcaatctgtaagtgagaaatgacaaccacttagtccagacc

SEQ ID NO: 9777 - DNA, 1287 bp, artificial
  synthetic oligonucleotide
ctcaccagtgaaatagagataatagtacagactctcctagacaggtaactgctagggtcagatagatcaataaatgtgaaagtgctcttaaatctgtgatgaattattgagatgcttgtgatagtaaggatttagagctcagtcgataaaaaaatcagcctttattccagatgtgataaatctggagcatgatagaattttaatatagaacacagtgaaacattttagaaggacaattaatgataattttttttgcatttttttctatacttgataaagcttatgttttatacaagaattgaaaatttttacctttacaattttaaacaacagggccatattccaataggtatcctttttttctttttctttgagacagagtctttctctgtcccctaggctggagagcagtggcgcgatctcggctcactgcaacctccaccacccaagttcaagggattcttgtgcctcagtttcccaagtagctgggattacaggtgtgagacaccacacctggctcttttttgtattttagtagagatggggtttcaccatgttggctggtctcatctcaaactcctgacctcaagtgatctgcccgcctcggcctcgcaaagtgctgggattgcaggcgtgagccactgagcacgggctccaaaaggtatcttatttgaaagcaagtgcatagaagataaatatccctctatgtctcatgccaactcttgacatcacaacttttcatccacaagaaatcacaaattctaacgtacatacctaataaaatgcataagataatgtaggtgtaacagaataggtagtaatggggactgtggctaaatgaagagcctgtgctagagaaaacagggcaacttgactcctgctctggttactatgtagaaaaacagactaaggatcatcagatcatttgctttctctagagaggttagaaattcttagttcatgtcacatttttttcaatttcaaacaatggtagctaataaactactattaaataccatagggactaaatagaactttatctaaatacatctgtaattttagatgcaatagaccaattcctagaaagacacaaatgattcgagctgactccaaaacggaaaatctggaaaaatgtaatgttgaaattccaattaaaaatggacatttttatgtgtattaaatacataaaaatttaattttaaaatttcccatttgcaaattccagttatgaagccagttaccaagcctgcataatcaggtacttaaacctagcaagcatattacaag

SEQ ID NO: 9778 - DNA, 1202 bp, artificial
  synthetic oligonucleotide
ctttttaaaaattacttgtaaatatgtttacttacctctctaattaaagaggttttgacccaagatacaaaaactgagatcagctttgcttatattgtggctttcatattccaattacattagtctattcatctagcaatcaaattaaataaaatctaaagatgttataattcccagttataataaaaagcctataaactcttcagtggtttacacagcacctggaacaatgtgacagatgacagaggactctgtcttcagttagtggaaactgctatattaacattcctatcaaaaatctatttttccttatatttgcatggtctcaaatgtatttctagttttatatgtgtaattttaagcacatcactcataaaataatatgtttcagtacagtaaaatttaatgatttcagattgcactgaaaggcatctttaaaagatactaaaaaatcaatttctgtggcgtttaccttgtcctaaaatatgcctatttaacatgtgcctcaaaagctgaattctagtccaagcacaaaatattgtccttaaaattgtacatcttctttattatcaattatggcataccgaattatatacttagtatgtttaaaaattctgctttttaaaatacatgcccttgcatacaaattgaatgatttaatgttttaagctattaatgccaaaaatgtctgagttatttggtattgatattcatcttggcacccatagaatcgttgattgcagtgaagagaataaaactgctgtaaaatattgcttctctgcacaaagtaaaacttacctaaaatattttgacgtctggtaggtagaaatgatgttaaaataatcttcctaccttaatttggtattaaatcttaatcatttcaaaattcattggtaatatttatttctaaagtgtgacatgattgaacagatgtcacatttataagttttgtttaaatatctttgagagaaacaaccttaaaaattaaaaggtaagaaacccccacaaattctaaaatgtcagatactgctacattagaggaattagttataaagccaaggagtgtgaaaacacgtgggcaaaaactgcatgacccagaggatgggaaataaaatgctgctaagccacagatgcctaaagcctatttttcattttcaataaattgaaagtccctttgaaacacacttctgtgcaagaaaatc

SEQ ID NO: 9779 - DNA, 1644 bp, artificial
  synthetic oligonucleotide
gccacattgaaaataagattccttatactaccaaattatagtttatgtacataatttccatatgtatgtcataataattgtaagaaagaagaaatcagcattgttgtataccattttatacaagagaaaactgagcatcagtaagattaaatcgtatatcaaaggtcatcatattaggaagttttagattcaatattagaaccctgctcttctacttataatttcagctttctttcagacatgctctgctgttgctaggggtatttcaatggatattattcaaaaaggtgtgagcgtatcagaatatatatcagagcaaacagagcttatagtttggatgtattagggatgttcaacatatttaactattaattcagcagggccaacaagatatcacaaggaatgccgggtcactcagaatggtctctgacagtctataggctgattaccaactctgtatacagctcaaataaactgaataactggtgcataaagagacacatagaccccagaaagaagcagtcaatggtatctgcatatttgtcaatgttcagacgatatctgggttctgttagggcacattactttcaagaggaacattgcaaaatgaagaggaatatgcatacaagtatgccttgaagagtgtgaatgagacagtgaagagcccagaaaacatttcatttcagacacagctgtagatagttgattaaaaataataaaatttagtataacaaagagatgttaaagaagatactacaacaaaagggcctgcagtcaccctttttgctctgctgttatcagttctgtctctactgcttactatctgtccctaataaagtacttcgacctttctgaacctcagtatttcctatgtaaaatagcaataaagatacctaccatgtgggacttctgaggggattaaaggaagctcgctatttatttcccaaaatgagatagtttttatagtaaaatggggagctaggaataattaagctgagaaaaatggtttgacataagctaagactatacccgacaaactgaaatatgtgctcattctacttaaaggtaacttcaataatcttaaaaagaaatttaggaaactttttttttttttctttttgagacggagtctcgctctgtcgcccaggctggagtgcagtggcgcaatcttggctcactgcaagctccgcctcccgggttcacgccattctccttcctcagcctcctgagtagctgggactacaggcgcccgcaaccatgcccggctaattttttgtatttttagtagagacgaggcttcatggtgtcaaccatgatggtcttgatctcctgacttcatgatccacccgcctcgacctcccaaagtgctgagattacaggcgtgagccaccgtgcctggccacggaaacatttttgacacaagagatgatgagagtaccttgttcgtggaaatgtccaaataaccacatataaaaagtgttaaaaaaaaaaaaaaaaaaaggttaagtaaataaacatcactgaaaatcgccatttctcctgggatctggccacccatacgttcgtcctcaaatgaaatatatgaacttctgttttcaggtaggttggatcagtagttcctaaaatttctaccgtctcccatta

SEQ ID NO: 9780 - DNA, 5089 bp, artificial
  synthetic oligonucleotide
aaagagaaataagagaaccaaagactcaaactccagttcattttcactctctggaatttgtctttatctgacagataaaggcaacaccctatataaatctaattcttacactcttcacatcccatccagctaccaggcactacattaatgacatatcgaattgggaactgtgttcaatcaaaaggcattaaagtacttattaactaggttttacggagcttccaaaaaaagttaaaaagttatttttggtggctctatggtaaggtgaccttttaattttttcttcatggtttattgtccccatgtgagaaaacactttctaaacacagctacgtatttggaccaaaatattcttcataggatgatgcattgtctttgcataaataacgaatcagtaattatatatcacacataaaaaacgacattataactggtcgaagcacagcttcaaccgtttgtgaataaaaggaaaacctccccacaacttaactgcaacttcaaaatttctaccagcctcatgatttgtaagttttaatatggaagtttctgctttctacactttacacgatggggattatgaaaacagtgctgctgggagaatggaaggagtaggagtgcgttcttaaagtacattttagcagagttgggagtaaattgcagcataatagtcaaggtaggacaactgctaggcttgataaaataatggttggggataaagaatggataatttcctacaagagagatttgtataaaatataaaagaaaactgtaccgaagcacatataaatatgagctgggcatgactgaaaggcagtaaatatctataatctcttctctatagtacaaatcttttcatataatacaaatgaaaaataatgtactatggaaataatttaagcatgatttaaactacagttaatgattaatatttgaaaatacacacatttatatatagcaaatcaatcaaataaatcccaagtcatataagctgttgaagaaacaaattatatttataaccaaataaatgtgttgaaaaactcaatttttctaagagaaaccactgatcacattattgcaaatgtttatgtatagttcaaaagatcagtttctacaaagtcacaatgtattaataaaaatcatcttttccacgcattaaactgttagaactattaaactattagaaaattcaactcgaattcaaaaagcatttgcaaacaaattttgctttgaaattttatatgatccatgattatttagagtaattgcaatgtcctcttattccaatattattaaatacccctgtattacaatatgcatataaacaatgtaatatgcccctgtattacaatacgcatataaacaatcgttcttttattttccttcagatattttgtttggatttctacatatggtgcctcttgctattatctaattctcctaataccagaatagaaaagcagtcactttgctcatggcataattttgccttcatttaactaattgggattattaaatttgtgcttaagagctgtgaaacagattccagaggagaaagatcttaaccagtgtattaaaaatctctgttgccagtacttttgtccctacttcaaggcaagactgaagaatcgaagactaaaatatgagaagaaatcatacatctctcaagggatcttctgctaggttttacgagaccaaagttctaactcagccccaagtcggccgagaatgggttttcatagacacatgcttaagtttctgtatgaccagagaaatatatctgctatctctaatttcaaaatatttccagaatctgacattctctcactaccgaccaagtccaagccaccagcatctctttttcaactcttgttgattctattattggtcccctacagttctactctcaacccagaagccagtgtgatccttttaaaacatgattgagatcatgccactcaactgctcagaaacttacaattgctctcatctcatttagaatcttctttacaatggccccaaaggccctccacaatctggacactcacaactcccatatcctcatctctttctacccttccactggcttgttttgcttcagccactttggccttcttgttggtgcttgattaagataagctcagtcccacatttgggcctctactctatttcctctacacagactccatggctgactcccttaccttcttccaatctttgctcaaaggtcatttctaccctatttgaaatggcaattccgccactttcaattatacctacgtctacccctgtagtggtcctatatccccttaacagattctggtttttttttttttcccaaaatacgtatcacctagtaatacgcaatatttacttatcatttttctttgtttgcttgcttctattctgtctcccaatgttataataaaagctgaatgagggcaaagattcgttagtctttttcactgttttataagcacttagaatagtgtgtggtacatactaagagcttaataactatttttggaatatacgaatccacattccttaggtttacttgtcctaacaattttttgtttctcaagagcaatgcaaaaaacctgaactcaagaggacttgaacgacctggcttcacactatctttggcttataagctcactaccagctttcccttgtggtctcgaacttgaacaagggttgtctctatttcttgatcctatttaaaatctacattaggaccaccatgtctcctacccgtgagctttcttcatatggccacgtttttcatcaccctcttggttacccaaagtatagcacattttattcattccaaacaaggcatctgtactataattggttttgatgagacaactgaaatgatgtgtgcctgatattttttctttccttccatttatttcctccttgtttctctccttattttatttcttttcttcaattctccctccctccttccctcactctctttcttccttacttcctcccttccttcctcctcctttcagtgatttgaaactccagtgcaatgtggaatattgaagggatgtgggcagatatccttgtcttgttcatgttcttcaggtgaagacattctgctctaccataaagaataatattagctgtaaattgattctcattattgcaaaaggtaaagcatagttgtcattcttattataagctatgttcttatttttgtcctaaaaattcacatttattgataccaaggcctaattgaacagctaaggattccctgaatgagggagcagcagaatcacttgaagaattccactccaaaggcatgaactatttctaagaatttctctacgtaaatgctaactacacagtaaatatgtcattatttatttcaaaaatgtcctagatagagttcccctataagcagattcgaagacaagggatgtctttgggaatgatccaaggaggtgctagtaaagtgtgtgtaaggtaggacagggagcaagtgaaatgtatcctatgaggcaggtttttactgtgtgcgatggggtcttaatcctggaacagaattttgggtcagagcataaatcatgcttcagagttaccctaactgaagaatgagtgagtagtggtatttatccaccaaaagttatttgttattggttgaggtttgctggggaacacgggggatgcagaactttaactacctgacactcatgagctttgattactagagagagccctaaggcaaacagtcagagacacttggatctggcagctaccagtcagagtacaaggcatgctgagtcaggaaatgatatgggtgacatcccaagagtgtttcatcctccaataaaactgatgctttcagtaaaattaggcatatggacacatgatgataaatcctttcagttaagtcttttaagtggatcatttctgcttttaggataagctttcaaatatttaactctctccagagaaaaccttttggtaatttaaaacttacgatgctaagaaattctgtgttcatgctttcatatgagatactttaaggcaggatttgacggtttaacacagtaattatattttggaaaattttatcatgaaaatgattttttcttaaaaatgaaatgcaagttaatattgctctaaacttccaaaaaattgcaattcttctaaaattatgtactcttgtctgttatgagtattattaactttgtacatataagcaatcacaatcaattaactgttaatattggctctgaagtaagaaagaaaatattacttatgtgtatgtttctcattcttctctagctctgccttagctagtgtttttgctattaaatgcagatttccacatatgtatatatatatacgtatatatatatgtttgtgtttatctgcatagtctctgtcaacatgattaggtagctttccaattcaatacatctattgaaaccatacgtgctattttagttgtattttgtttagaaagtaattcttttaacatattacatattatttgtgttgtactgcactttcaaaaaagatgtatgttaaagcacagcaatacttactatagttctgtaatttgattcatgcatatctgtcaggaataaaatcaaccacaatttcaaaccttcccaaccagcagctgtacaatttatgcactgcttttccatttttactactggataatgacaatgatgaatgcctttaacaggaaatacatattcactgaaaagactgagctcaaaactatcccccttcaaaaaagtcaatgaaggtaggaagcccattcacctgctggagatttgttgggagacagaaggaatcatgcccacaactgtatcttatggggattcaaccatttagctaaattaaatctacaataataccatattataaaccgcagtaatcaatactattacgattgacatcagctataataatattaaatagatcaggatgaacaaatgattcactgtgagtgtagccaagggtctaacattctgagtatgccaggctaagaggtatggagacagagttattcaatgggcaacttaataagatcagggtcactactctcctgaaccaaatg

SEQ ID NO: 9781 - DNA, 4527 bp, artificial
  synthetic oligonucleotide
catttgtcctccaaaagcttggatttaaaatataacagattcacgtactatgtatgactgaaaacatacttgcctggaatgttaaagatcagggtaattttctgtctcgttaatctaatattgacagtggagtataaaagtctctcactattactgtgtaggagtgtaagtctctttgtaggtctctaggaacttgctttacgaatctgggtgctcctgtattgggtgcatatatatttagaatagttagttcttcttgttgcgttgctccctttaccattatgtaatgtaatacccttctttgtctttcttgatctttgttggtttaaagtctgttttatcagagactaggattgtaacccctgtttttttttttattttttttaattttttatttttttgctttccatttgcttggaaaatattccgccatccctttgctttgagcctatgtgtgtgtttgcatgtgagatgggtctcctgaatacaccacactgatggtcctgactctttatccaatttgccagtctgtgtcttttaattggggcatttagcccatttacatttaaagttaatattgtcatgtgtgaatgtgatcctgtaattatgatgttggttagttattttgcctgttagttgaggcagtttcttcatagggtcgatggtctttacaatttggtatgtttctctcagtggctggtaccggtttttcctttccatgtttagtgattccttcaggagctcttgtaagccaggcctggtggtgacaaaatcactcagcatttgcttgtctgtaaaggattttatttctcctttgcttatgaaacttagtttggctggatatgaaattctgggttgaaaattcccttattgaagagtgttgaatattggcacccactctcttctagcttgtagggtttctgcagagtgatccactgttagtctgatgggcttccctttgtgggtaacccagcctttctctctggctgcccctaacattacgagcaacttcagccaagtctcagaatacaaaatcaaagtgaaaagatcacaagcattcctatacaccaagaatagacaaacagagagccaaatcgtgggtgaactcctattcacaattgctacaaagagaataaagtgcctaggaatacaacttacaagggatgtgaaggacctcttcaaggagaactacaaaccactgttcaagaaaatacgaaaggacgcaaacaaatggaaaaaacatttcatgctcgtggttaggaagaatcagtggagtgaaaatggccatactgtccaaattaatttacagattcaatgctatccccaacaggctaccactgactttctttacagaattaggaaaaattactttacatttcagatggaaccaaaaaagagcttgtatagccaagacaatcctaagtaaaatgaacaaagctggaggcatcatgctacctgacttcaaactatactacaaggctacagtaagcaaaacagactggtactggtagcaaaacagatatatagaccaatggaacagaacagaggccagaaaaataatgccacacatctacaaccatctgatctttgacaaacctgacaaaaacaagcaacggggaaaggattccctatttaataaatggtgttgggaaaactggctagtcatatgcagaaaacggaaactggaccccttccttaccccttatacaaaaatcaactcaagatgcattaaagacttaaacctaaaaccgaaaaccatcaaaaccctagaagaaaacctaggcaataccattcaggacacaagtacggggaaagactgcatgactaaaacaccaaaagcaacagcaacaaaagccaaaattgacaaatgggatctaatgaaactaaagagcttctacactgcaaaagaaactatcatgagagtgaacaggcaaactacagattgggagaaaatttttgcaatctatacatctgacaaagggctaatacccggaatctataaggaacttaaacaaatttacaagaaaaaaaaaaacccatcagaaagtgggctaaggatatgaacagacacttctcaaaacaagacatttatgcagccagcaaacatatcaaaaaaagctcattatcactggtcattagaggaatgcaaatcaaaaccacaatgagataccatctcacaccagttagaatggcgaacattcaaaagtcaggcaacaacagatgctggagaggatgtggagaaaaaggaacgcttttacactgttggtgggactgtaaactagttcaaccattgtggaagacagtgtggcgattcctcaaggatacagaaccagaaataccatttgacccagcaatcccattactgcatatatacccaaagtattataaatcattctcctataaagacacatgcacacgtatgtttattgcagcactatttacaatagcaaagacttggaaccaacccaaatgcccatcaatgatagactggataaagaaaattggcacatatacaccatggaatactatgcagccataaaaaagaatgagttcatgtcctttgcacggacatggatgaagctggaaaccatcattctcagcaaactaacacaggaacagaaaaccaaacaccacatattctcacccataagtgggagttgaacgatgagaacacatagacacagggcggggaacatcacacaccggggcctctcaggggatggggggttaggggagggatagcattaggagaaatacctaatgtagatgatgggttgatgtgtgcagcaaaccaccatggaacgtgtacacctatgcaacaaacctgcccgttctgcacgtgtgtcccagaacttaaagtataataatgaaaaaaagatcagggtaaaatatattttgtcattgttttgaacatagccataggtaggatcataaaatagcacaacttaaatagaaaaataaatgattcagaatcaggtctcaggtacaaacagccaaaataattcaatgaaattatttctctatactacaaattgtggactcacatggcatcatatctgatataaataatagtttattttaaatgaatatagacaggagtggctggaaactaaaagcatgtatttcttctccataagatgaaagaggatttaggatacacttaagataacatactaaatcttgttttgccagtgtagcttctgcttggcatttaaatatctgttacttaatagaaacattcaattttggaccctaaaatatcacacaatattattcattaaaattatacctactcaaatctgtctagccatatcatatagcgactgatatttttagatcaaacccacaagtgtgaaatatttttcattttaaagactcttttacatttaatatgtattcatgctaactttttaaatttaaagcaccttctatgaaatgtattttaatacaaataccctatattgtataatttacttcaacgttgtaaattttccacgacgatgtgtatcattcacaaataatatgaaatataaaaattcacttaaacatatataaaattattggtatatttactttgtactaaatgtaatgggatttgatattattatattaaatttatattcatgatgaatataagtaaacattgagtaagaaatgttttaagaaatttgctatctgcatgaatgactattcaatacatttttattgaacatccatcgagttcgttgcgatgaatacagttttagaaaaaatactaatactctggcttcgaagactgctatgtattgaaggtctacaatgctttgaatgctgtaggaagacaagataaattaggacttttgatcaccgtcccataaaagcttataatttgtctaataaggaatagccaacaattattacaataggagacagtaaaaataagtagaatgcaatgttccagatgttcagaggagttggagatcatctccttatgggttggtcaagagagccttaatggaaaatgtagcatctgagcagggcatggaaggatcatttagtggatattcctctgtcccaaaattttttgtctgtccaatatcccttctgtggtgaagaaaattagtactctttggatatcttggtattgatttcattatgtttctcatgttcccttgaggtttcgtgagtgcaattgtgattgaatcctggaaagtgggaaagtgtaggaagtgatgcatcacttcttgcctgaggtacttgatagttagtgtcaatttctcagctctcctttgtcaatacctctgaagtttcaatgttgacatggcagagccacaagatgaaagcaatttaggtccctgagtcactgtgaaggaatgctacctgatttatatcagactttatatgagcaataaataagcattcattaggccactttgatttcagggttagtttttttgtggcatctaacattaattgttctgaataagtatctccactctttggtgaatggtaccctgcttttccttggatgaaattactcttccctca

SEQ ID NO: 9782 - DNA, 1233 bp, artificial
  synthetic oligonucleotide
gtgaatgcgatgagaaaggcaagtcaggacagtgagagtcaggttcattacactgcattctcacactataaatgaaagagtagcaagtattggctaaaattcaataacttccatggccaagatacctactataatttgaacattgattccctttgagaagctttctcctgaggcaccatcaagacagatattaataattagtagttcagctaggggttggaccacaaatatcaacctgaacaaactacagaacaccctccacatttgcttcagcactgacagttttgaacactccctggtggccaaactcacttgttttcacctttgaaatgagttagttttcactgagtgctgttgggtactgagccactagcagaagtgaggatgtgcagtctgatgactcacggttgcacgccactaaatactgccaattacacacatttttccccttgcaaattttggggaagggggaggggtgtgaagggggaggggtgtgaaggaggaggggtgtgagcagctgcatataaggagtgcctatactttctttcttttcttttttttttgagacagtcttactctgtcacccaggtcggagtgcagtggtgctatctcagctcactgcaacctctgtctcccaggttcaagcaatcttcccgcctcagcctcctgagtagctgggactatcagcaagcgccaccacgcaaggcttttgtgtgtgtgtgtgtgtgtgtgtgtgtgtgtgtgtgtgtgtgtgtgtatttttagtagaggtggagtttcaccctgtaggccaggctagactcaaacttctgggctcaagcaatactctcgccccagcttcccaaagtgctgggattacaggcttgaaccaccatgcttggccaggagcacctatagtttctacctcaaaaacatagccccctatacctttccacagattatattgttacttttgatattgaacttcttttcattgtaaaagcctggagaaaatttaaggctgtttatatatctgttttctaaatcagcacaccaactgtgaactctgcacttttgaattgggatgagagaatggaaagaaaaaaggttgggagaggagcggagctgggaagaaaggtgatctctagtcctttttcctccgctccctgctccagctcacttttccaatcagtttttataataagcattatttattctcctacaaaagtctcaaagtttactagttataaaaaa

SEQ ID NO: 9783 - DNA, 705 bp, artificial
  synthetic oligonucleotide
catactgtaataaacatccatatacccaccatgcagatcccagcaattataaactcaagggcccatatggtttcatctacatcccaccaagcgcaacccacccctaaacctagctttgtattattttgcaagtgacctaagtgatccttcttttgctgcttggaataccaagttaatgagttatttcatgtgagatagctaataaatcacaaagctgttgcttgagaataggtgtcccaatattgctgtgtttcattttcattctatgataggtagcgtttttatgatatatgtcattggcagcaaaaaattatatactttactgattgacatatgacttctggtgaacgcttaaaatacttgattttgtttttatatacatatgtatgtatgtataagcaaagatcatcccatattcctattaaatagataagttgatatttgacaaatacactgactttagaaaaaatatgaaatcaaatataaaataatacagctgtgtacggtacattgtgatgttaacataaaagaagtagtgaacaggaatttgtgtatgtgtgtatttttgtatgtcatatatgtttgttagcatagaaaaagcagccagaaagttacacaccaaaatgttaattctggtttccaactggcacttagattttctagtatgcttaggttttcatattagcatactgataagaaaggtat

SEQ ID NO: 9784 - DNA, 2176 bp, artificial
  synthetic oligonucleotide
aaggacaagaatccagtccatatatgaagtataagataatatccaaacatgttagtacaacagggagcatggaaaggaccatcctcctcttctccccactgccttctcggctccgtctcctgccgcttctcctcctcactttcaagcttagctccaatgcccagtaaaactgagtaactttctacttccttgacgatactgttaagttgtataggacaaattcgttactcatctttaatagttagcataaaagtaccctctttctagaggacttttaagaggcctaggggaactaagtgcccctcctttgtataggtatttataaaatgtttccatttgtgtcattctcatatgttttggactttacagctgaatattaagcatgaccgaatgagggctttcttctcttgaacagaaaatacatctctaaatttgaacggcactacagattcaacttttaactaaggacctccagatcttttattagtaatttgcaaggaactcagtcaaataaaaaggtcctgtcttgtgctattcacaatagcaaagacatggaatccatctagttgtgaaacaatggtagattggataaagaaaatgtggtacatatacaccatgaaatactacatagtcataaaaagaatgaaatcatgtcctttgcggaagcacggatgcagttggaggccataatcataagcaaattaacgcaggaacaggaaaaacaaacactatatgttctcacttataagtgggagctaaacatagagcatatatggacgtaaatatgcgaacaacagataccgcggactagtagatgtgggaaggagggagggtgcgcattggttgaaaaactactcatcaggtaggtactatgctcactgtttgggtgatgagatctgtaccccaaacctcagcatcatgcgctattcccctgtgacaagcctgtacatgtaccctctgtatataaaataaaatttgattattttaaaaaggagcagtctttacaatgaacgatcagaaataaaatgcacctttttagcctcttctttctcctgttatctttttttttttcaatttcagtaaacatttattgtaccttactaatacaaatgctgaaaccatacaaatgtgtgtgttcatttgttacaggaactagagtcaggagcaggccttgttagatttcatttaatactctctttttcctgtgaggtataatagtagatatgctcttggtacaatttcccatctgctcctgataatggttgctataaaagaataatgagaattccttctaaaactagaaatagactgtttattttccaaagcaaacatcctgccaatgaactgaaggaaaattatgtacagtagcaatttattttaatgggacatttacctaatatcaaattgtaatgaaatttccttttgatgtatttatcttattcatatcaattatatatatatatatagatttgttattatcactgctattaatgtgtataccaaaattaattcatcataaagagctttaagtactacatgttttgtaagggtatcttgggttgtttttctttctcttccaagaaatgctgccctgggccaaaaagaaaaaatcacgtgctcctcaatttcaagcagagattcaatacagtgttacctaaagtgaggaaaatataaatatgttaagtttttgccctctgaaactgagggctacattttaaatctggtcccagacatgttttggcgttagaactttgtttgattaatgatttgaatgcctttaggtggggcatgaaagcattcaatcattctgtaaaggcatttgaattggtggctcttgttttaaagaaaactgttgttacaaagtacagaacagaactttgcaaagcgaataggttttagtttgctaaaataaatgttagctctctctacgttcaaggatttatttaatccttctcgccttctaactcattcatgagaacttcaggacaaatagaaaacatttaagggctgtgtttttctctccatttacttagatttgcaaagaaaacaaattggcctttccctgataaaaaggcatcttgtccacagctgtacttgttttcttattaagtgatcctggttatagaacatgtgacttcaggcataaaattctttctacatgattactagcatgcct

SEQ ID NO: 9785 - DNA, 1071 bp, artificial
  synthetic oligonucleotide
agttctctgtttaagcatattatggacactccaatttgacagatactactctgatacagcttaataaatttgtattcagctgctgaaacactaacgagaattgagaagacctgggctgttggacctttgaagtccagagatttcaactctcagaacctggttttcatctttaattgatagaattggacaacctcaagaagagagtagtttcacttggagtgatggtgctgggctgctcatgaggattctgcaggttaaatgcagtcaagcactatagcacggtatcaggttatttgctatccatagactagataatagcaaaagtccttgcaaatttcaaagttctatgactcagtgagaacatttattatttagccagcaagtaagcacatagcccactattcagcatgtgtctgtacatataacatcctagagccctactactcaaagtgtgcgccagagactgacagcagcagcatcacctgggacctactgaatcagcatctctggggttggggctaagtaatctatgttttaacaagctctccaggcaattgctatgcatattaagagaagcactgattcagagcattgtgagaacatagaagatattctaggctttgcctcaagaactttagttttggataaaatagatgtaaaacaacttagcaaaatctttcataatgaagtaatatctgtaggtcattcattcaacaaatattgagaacctactatttgttaggcattgtgttagtggctggggttataatagttctgcttttgtgacgcttacaatctagtgaagtatacccaaataaacaaatatataaattttaaaaatacggtttttaaaaaatactatgcaggaaataataatggtgctatgaaaacaaagaacagaaatggctttgaggggtggagagtgatacatttaactttattttaaattgttaataataatatgttaagatttagttagttgataaatcagcaaataccaactgcatgcatgctctgcacccagataagcatcttgtggaatataagagtatgccctggaggagtttataa

SEQ ID NO: 9786 - DNA, 2013 bp, artificial
  synthetic oligonucleotide
gtctgaaagccaccactgtcaccaacacccttttgtttcttaactaatctgagttgagttttctgtcacttacagccaagagtccagcctaatatactttataataaaggggaaactacagaaacatttaagaaaattagcattgatcctaaaagttgttacaaattacctcatcacaataactattcagagcaacgtatttaagttgctcaagaaccacaaagcacattgcctttttaaatttaaagagacttcataaaaatgtgggacagagcagaatggtacccattattatagaatgattttaccaactgcggcattaattctccaaagatttcccccagtctcattatgaagaaataatagacatagaatactaggctgggtgcggtggctcacgcatgtaatcccagcactttgggaggccgaggcgggcagatcacgagattaggagatcgaggccatcctggctaacggtgaaaccccgtctgtactaaaaatacaaaaaattagccaggcgtggtggcgggcgcctgtaatcccagctactcaggaggctgaggcaggagaatcacttgaacccgggaggtggaggttgcagtgagccgagatcacaccactgcactccagcctgggcgacagagcgagaccccatctcaaaaaaaaaaaaaaaaaaagaatactagatattagatgccacaaggttatcaatatacactagtttcgaggctttttgaaaattttggtgcacccctatccagcatatcccgcccctctctatttcacattccctgttgctaatattaggaaaagagaacgtttacgtgagtatgctatttgatttgaaccaacctctcagggtcaataatatttcagtattttgtgtgcagcatttaagattataaagtatgcccatttcagcactccttttaaacagaaagatttagttgaaaactcaaagccacatttgtccactgaaagcttttaaaaagcttcatttgtgaaaagacacattgaccagagctgctggggatcattaatgaaagctggatcttcaaaggagattctgtgttacaaaaaggtacttggacattttggctaagctgcagaccacctgtgatttggccatttgatagagggttggttgttgacaggtcctaagagataccccctatgtctcttctttttaaaattgtattaaaagatttgtatcatgggctccctatttaaaatgaaagtctgggcagctgccccttttactccgtctagaagaaggtaccttacattttctaacatgagttttccatcaataattgtctgctatgacaccaaagtattccccacctcctggctggagagcatgttgtcttggtcatctcctctgttatgttggagacagagtgacacacgtaggtgaatggggtctaaaccaattaaatccttgtctgggtctaaaccgattaaaaaggaactcaaatctattttctctcagattgggagagtccacgaaaataaaaaagccaaacaacagaaatgctgcccagttgcacaggatgttgctattatctagcatttgcacatcaatttatgttttcaaactcattgacagtcactagttaccggcaggcactctgttaagaagtagagaactctaagctgagttttgaccatagattcccggaagtgatttacaagatcattttcaaatttgtatgaccaaaaggcattttaaatatgattttaaattgcaaagggacgaaatcatgggcttcttgtgtttctttggatgccaatcacattacttcgagagctggcataggtcgtggatgtctcaggctacgcaccactgataacacaaactatgcgggcactggagcagaaagatatgagcagaggaagagagataagtggtgcctctaagaccccagaaagtggttttgaacccttgtggatctcactggaaagggattaggagaataccacctggcagaagaccattctcttattaaggct

SEQ ID NO: 9787 - DNA, 3834 bp, artificial
  synthetic oligonucleotide
cactctgcaataatgaatatcattctgcaataagaataaagtatcattctgcaataagatgaaatgttctgcatgtaatacatgggcagactcagtattcccccagctcaaggcttgggagaaattgtgacttatagccacagaccatatatatttgcctagtaaagctagaaccataggcctctggcttaagggaaggatgagacgatctgttctggaatggggggcggggggtggtgtcaaaatcaaggacatgcacaaatgttgcaaaggctcctgcagagcacttcttgtccatctaaattgaccacgcgctacctttcagaaagacttacaattgagggtatgaagagaaacacattccatgacatttattaagtatggtcttggccatactctctatcttagggaagccctgatggaggtggtggaatatgacttagaaatcctttgcttttctgctccattggtctatatgtctgttttggtaccagtaccatgctgttttggttactgtagccttgtagtatagtttgaattcaggtggtgtgatgcctctagctttgttctttttgcttagaattgtcttggctatacggggtcttctttgattccacatgaaatttaaaacagttttttttttaattctgtgaagaaggtcatggtagtttgatgggaatagcattgaatctataaattactttgggcagtataaccattttcacgatattgattcttcctatccatgaaagacctcagaaataataccacacatctacaaacatctgatctttgataaacctgacaaaaacaagcaatggggaaaggatctcctattcagtaaacggtgctgggaaaactctctagccatatgcagaaaacagaaactggacccctcccttacagcttacacaaaaattaactcaagatggattaaagacttaaatgtaaaaccccaaatcctaaaaaccctagaaggaaacctaggcaataccatttaagacataggcatgggcaaagacttcatgacaaaaacgccaaaagcaactgcaacaaaagacaaaattgagaaatggaatctaattaaactaaagagcttctgcacagcaaaagaaactatcatcaaagtgaataggcaacctacagaatgggaaaacattttttcaatctacccatctgacaaaggtctaatatccagaatttacaaggaacttaaacatattcacaagaaaaagacaaacaaccctatcaaaaagtgggcaaaggatatgaacagacacttctcaaaagaagacatttacatggccaacaaacatatgaaaaaaagctcaacatcactgatcatcagagaaatgcaaatgaaaaccacaatgagataccatctcacaccagtcagaatggtgattattaaaaagtcaggaaacaacagatgctggctaggctgtggagaaatgggaacgcttttgaactgttgatgggaatgtaaattagttcaaccattgtggaaaacagtatggcaattcctcaaggatctagaaccagaaataccatttggcccagccatcccattactgggtatacacccaaaggaatataaatcattctactataaagacacatgcatatgtatgtttattgcagcactatttacaatagcaaagacatggaaccaacccaaatgcccatcaatgatagactggataaagaaaatgtggtacatataaaccatggaatactacgcagccataaaaaggaatgagatcacgtcctttgcagggacatgaaactggaagccatcatcctcagcaaactaacacaggaacagaaaaccaaacgctgcatgttctcactcacaagtgagagttgaacattaagaacacatggacacagagagggaaacaatgcacaccagggcctgttggggtttgggggttgaagggagggaacttagacgatgggtcattaggtgcagcagaccaccatggcatacatatacctatgtaacaaacctgcacgttctgcacatgtatctcggttttttggtgtgttttttttttttagaagaaaaaaagaaaaaagaaggggggagatctcattttaattgatttagaccagaatcaaacattttaaaaattaaaaaaaaaaaaaagaaatactttgttttctcagcctgcagggaggtagaagagtgcttacatcagggctggccaagtttttgtttcattttgttttttgttcccctttattgcccaaagcagcaaagagtaacttaggtctctgcaacttgattgcgaagatacgccaaggaaaatccacctaacagtgcagggaaggactactagagtagttttggtgatgcccaagatggcagcctcacagtggtggattggccacatttggttatacaaatggccagttttcaatcaaaaacattagaaagttgaaacagctagaagcaatagctgagatgatgatgattattttatttgatttatttatttttattcgtataaatttctgaggtacaagtgcagttttgttacagggatgtattgcatagtggtgaacctgggcttttagtgtatccatcaccaaagtagtgcaccttgtacccattaagtaatgtctcattatccacccctcacccagcattctgcccttctgaatctccaatgtctatccttcttatcatgatgattttaagtatcaattctcccccctcccctttattagaatgacttggataagcctccaacttttttgaatctcagctgtttcttccttttttttttttttaacttttatttatttatttattttgagatggggtctcactctgtcacccaggctggagtgcagtggtgtgatctcggctcactgcaacctccgcctccctggttcaagggattcccctgccccagcctcctgagtagctgggaccacaggtgcatgccactacattcagctactgttttgtatctttggtagagatggggtttcgccatgttgcccaggctggtcttgaactgctgagctcaagtgatccacccaccttggcctgccaaagtgctgggattacaggcatgagccaccacgcccgactgatagccgtttttttctttattggataataagtggagtgttacaaggattaaatgggaagatacagatgaaacactttgtcatttagcacatagtaggcacacattaaactttgcttttcttcctgtctagcagattacatggacttatctatgagacacactgtttacagaaaactcatgaacaagaaatagtgaccaaaaggaaagaaaacaacaaaacgattccttctaaagcaacaaagaagcaagttaaaaattacacattgcactgaccatctgacatgcaatggctttggggaccaagatggatgtggataagctgagaaagaaaaacagaaaaaagcagttgagagtttcaggaagagcagcgaggcttttcagtttcatccccccaggagttaatggtatcacagaaaacgtgatcatttgccgaatgccgacagtgagctaagtctcatctaggacctgctcttagaagctttccagagtcaatatccagagatactgtttttctatcttgtacaacggtttaaaaaatttgcaacgtgacagcactgatttatacaatgcactcacagtctatttctttaaaaaagaatacatacacagagagagagagagagagagagagagagagagagagagtgttttaccgtgttaacatttttcctgaagaaagtatttaataccctctccctaccccctactcccccaccctatcccctggaag

SEQ ID NO: 9788 - DNA, 1244 bp, artificial
  synthetic oligonucleotide
gcattttcctgcttccttattcgtctctgtctcccctctcctttcatttagacattttctatgactacattttaggaaaaatagaggggaaggaaggtgcataagtggaaagttagtaagagaaatctaggacaggagaagaagtaaaggagagattattatatttatatatgtatgtgtatccacacacacacacacacacacgcgtatattccccataaaagttgagggaaatgttgagggaagaatagattaagaaaaggcaatatatgaattgggatgtttatctattactgatgagaatgtaagatgatgtaatccctatggaaaacagtttggcagtttctcaaaaagctaaacacaaaattgccatacaacccagcaatttcacacctatgtaaatacctaaaagaactaaaaacaggtgttatgttcatacagtattattcacaatagccaaaaagtggaaatgaccgccatgtccatcaacagattaatggataaataatatgtggtatattcatacaatggaatattattcagccataaaggaatgaagttctgatacatgctacaacataaatgaaccttgaaaataatatgcttagtgaaagaagcccgtcataaaatattatatagtgtataattccatttatataaaatgtccaggataagcaaatccatagagacagtgagtgggtcagtggttgccagaggttgggcaggagaaggaggcagggacaagttgtggggaggggcagtggctactaatgggtacaaagtttccttttgcagtgattacaatgttctaaaattagattatggtgattgttgcaccattgaattcgtattctttaaatgggtgaactttatattatgtaaattatcaatcagtaaagctgttaagaaaaattagtcctggcccaggaaaggaagtcagcactaattttaggaaacagttctcccccattttaaatttggttggtaaaattccaagaatcttaaacagtagggagagaattatatgcctatactcacatgatattttccctacatgtcctatttgcaggattaatgcattagttcaattatttaacaaatatttatgcattaattagccctgtgtgcatttagagatgcaagggtgaataagacaatcattgttcctgcttcacggatattctagtggaagaaaccaaaaaaggggtaagaaattacaaaaatatgttgaaaaatgccataat

SEQ ID NO: 9789 - DNA, 3743 bp, artificial
  synthetic oligonucleotide
taaaatgttgaggcagattgtaccagtgcctgttttattccctaggaacaaaacagatataataaatgaattcttggggtctttaaaatctctgttttaaatttactttttaatttctggaatggcttcacatggctcatgaatcaagaagtatgaatagaatataggaaatcatctttttcccacctctgtcttccatcagccaccccaccagcactgctggtagtgtctttgtatctttccagagactattaatgtatattcaaataaaatgtgaaaataacaataataaagttctatcagcctcctgtgatcactaacaaatccctatttaagagccttggcactcacagtgtggtccaaagaccagcagcattagcattacttggaagtttcttagagatgcacaatcccaggccttgccctacatccatgagtcagaatctatgtctttgttcattttgtgctgctgtaacagaataatagtctgtttataatgaacagaaatttattgcttcacagttctggaggctgagaacttcaatatcaaggtgctggcatcttgcaagggacttcttgctgcatcatcacatggcagaagatgagaggacaagagagagagaagggggccaaacttgctcttttataatagtattaatgccacctatgagggcagagtcctcatggcttaatcaccttataaaggtcccatctcttaatactgttaaaatggcaataaaatttcaacatgagttttggagaggatgagcatccaaaccatagcattcttcccctgaccccccacaaactcatgtccttctcacatccaaaatatatttattccatcccagtagctccaaaagtcttaactcattacagcaccaactcaaacatctaaagtctaaactcaaaagtctgaagtctagagtctcatctaaatctgatatgggtgagactcagaacataattcatcctgagacaaatttccttccagctgtgaatctgtgaaatcaaaacacattacaggcataggataggcaatgtcattccaaaaaggagcaacaggaaagaagaaagtggaaacaagtcccaaataagtccaaaacacaacagggaaaacaacactaaatcttaaagctggggaataatcttcttgacttcatgtcccatcatctgcatatactaggcaggggttgggcctccaaaacctccaaaaccctggggtgggggcactcccatggctttgctggttgcagcccatgcagcttctctcatgggttgaagttggatgcctgcagccttcctacactggcattgcatgctggcggctctatagttatgggatctctagggtggccttgctcccacagctccactaggtattgccctagtggagactttctgtggtggctttgcccctctggcaaatctctgcttggattccaaggctgtctgtgacaacctttgaaatataggtagagaaaactgtgcctccacagcccttgcattctgcaagcctgcagaattagcaccacttggatgtcaccaacgtttaccgcttgcatccttcggcagtgcgtcgagcttcgttctatccatactaatctcattaaactgttggttggtcacaccactgcttttactggttttcttttccaaatatgcttttttattctttatgtatgaatatgcttttttattctttatgtgattaggttggggatttaaaaaaatctttagccaggtgcggtggctcacgcctgtaatcccagcactttgggaggctgaggcaggtgcatcacgaggtcagaagatcaagaccagcctggccaacatggtgaaaccccgtctctactaaaaatacaaaaattagctggatatgatggtgcacgcctgtagtcccagatactcaggagtctgaggcaggagaattgcttgaacccaggaggtggaggttgcagtgagccaagatagcaccactgcactccagcctggcgacagagtgagactgtctcaaaaaaaaaccaaaaaacaaaaacaaaaaacaaaacaaaacaaaaaaaacttaacattctgcttcccttttaattataaatttcatgtttaaattctttctctcttctcgcattttactacatgaagttaaaagaagccatacagcacgctgaatgcttttctgcatagaatttactctgccagatatcttaacttattgctcttaagttttgccttccataaagtcctgggacatggacacaatgccaccaaattctttgtaaccttataatgaagatagtcttttctccagttttcaataccttgatcctcattttcattgaaaacatcatcagaatggcctctactgtccatatttctaaccactaacctctaagaaaatttagactttccttacagctattcttatctcctgagccctatcagaatcatccttaatgttccattcatagcaatgtgagcttttttcagcattcacttcaaaactattcctgcctctactcattacccagttccaaagctacttccacattttcaggtatttgttatggcaacattccacttctctggtaccaatttcttagtctgttttgtgctgctatgagagaatgccacagactgagtaatttataaagaacagaaatgcaacggcttacagttctggagggtaggaagtccaatatcaaggtgctgacatctgtcaagggctttctttctacattatcgcatggcaaaagagagagaagggggctgaacttgcccttttataaagtattaatcccacctatgagggcagagtcctcatggcctagtcacctcttaaaagttccacatcttaatactgttacaatggcattaaaatttctttctttctttttttttttttttgaggcggagtcttgctctgtcacccaggctggagtgcagtggcatgatctcggctcactgcaacctctgcctcccaggttcaagcaattctgcctcagccttccaagtagctgggattacaggcgcacaccaccgtgcccggctaatttttgtaatttttttttttgagacggagtctcgctcttttgcccaggccagactgcagtggcgctatcccggctcactgcaagctccgcctcccgggttcacgccattctcctgcctcagcctcccgagtagctgggactacaggcgcccgccactgcgcccggctaattttttttttttttgtatttttttttagtagagacggggtttcaccgtgttagccaggatggtcttgatctcctgacctcatgatccacccgcctcggcctcccaaagtgctgggattacaggcgtgagccaccgcgcccggccaatttttgtaattttttagtagagacggggtttcaccatgttggccaggtaaaatttcaacatgagtttttgaggagacaaacattcaaaccatagcaatctgcactttaacaagatccccaagggatttgtaatgccttaaagtgtgagaaacaattgtttaggggaaagggaccataggggtgtcaagatctataggctatagggtacccaaagtatcctcaaagagttctttattcttttcgggaaaaattaaaactcagtatatttgcattatccttgtcacaacgtttccagataatcttctgttgtgcttgtatgcaatgatgtgcaagtgtcctagacagacatttatggccctctgaatgcttatccctgtc

SEQ ID NO: 9790 - DNA, 492 bp, artificial
  synthetic oligonucleotide
agagtacatatttttgttcaggataatcagaaatgagtataagagagattcttaatgttttctattaagcaggctcatttagaataaacaaaaccagagctattatcttctatggattaagactggaataataaaaattattggaaggagattttttgtcaggtctcccatatatacaggtgttcatcagagacaccatgttccccttctctccctctcagagagagacacccatggatggcaggcgtgggcagggccgtgcctgtcgtacacagggctttgtatatgctgaagcctgcagctgtttattattgactcctaattagctccaacaactgtgtttggctaattgaattgcactccctgctagccacctgagccttcccaaaagaagattgcccttcaaaactaaggaaagaaaatattcacaccattatccagccccagattcttggcttgagccaagcacctatgtagctcaagccaaggatt

SEQ ID NO: 9791 - DNA, 957 bp, artificial
  synthetic oligonucleotide
actgcactttcaaatgaacactggtgtaagacaatggaaaacaattcccctcaagtagaaaataacatatgcatctccatttgaactgtatgattctattacagctccataacctccgtgttcagatgttaatgaaatacttttcagcatgctttaatagtcaggatccgctcaataaaagctttactgctaaatggtcgcatccagctgttctcccagggttgtgtggaccctgctgccatgtgtccatcaaaaggaacaatgcagaggggtctccgaaggactgctttggccagtgttaagtggcagaacggcaatgtttccctttatgagatgaaggacgtttgtacttaacagtctttaagaagaagaaatactgagagcaatttctgcaaaaccttaagattaaatgcgtggtttttctctattgtactgcatctggtttccgtagaatgaatcttgttgatgccagtctcaaggttgctattctttgtgcttttaaaccaaggtcaagcaagaggcagctcagaggccttgagattgtcattgacaaggaaaatagaagctttatagctggagcactaattaatcatttctagaaaaatagaaataggaaaaatataaacatatacatacatacacatatatgtatacacataaaattttgcatgtcaacagctactaaaagtttactttgtgatcttatccttaaaattgtatgtgtataaacatactttaggatacatttaaatgtatgttctgtagctagatgagtttagagaaaaaatataaagtggtttctattacaatatctttctgaattactgttgaagtccaggctgctcttcaagaagtctgaagtttcagaattaactgtttcaattaaaatcctaatctttgtcaccaatgagtttcactggatcccaatatctcataagtaacttaagacaaagaatg

SEQ ID NO: 9792 - DNA, 1006 bp, artificial
  synthetic oligonucleotide
agtaataaatagctaccatttatgtctgaaacatagttatttgccctaggtttcctaacacgaattgagctctcatttttaaccaaattattttcaaactcttgcgaatgcttgggaatgaggaaaagaaataaaacaaactagtttaaatgcaatgaaaaaaattattttggttccattaaaaacatctaaatggctttctactttccttggtcactcaatactcacaggaccttattctattagttactaaggtaacccaaagctggcagcatgttgacatacctttcgaggccaagaggttttgcagtatttcatagataatgtcacattaacctcagacttgtcctttccacaatagaatagtaattgcttggatgaatctaattttattctttgggtttttgttaaaaaaagaattttttgctgcactttccttcaggtcagctaccatttattctgtttttaaaataacatagtagtagaagtcagatgtctttgttgatttctacattaagccattcttttggtttttgtgccatttactcacagcctgggccagaatccgtgttgtcctctaaatggccctcagaagagaggaaatcctttgctctgttcttacagccccataaagatatacctgaagaaaatcaagtcaaacaaaatgtaatagggatgagtcaaacacaatgctgagggttcattagtctcttttcaacatagtaacttctatatgtaaccaaaagtaatgataaatttaaataaatgtaaatttgaataaatatattaaacattaacaaaatcaaatatactgaaaagtctttttttatacacttaagaaaaatttgagataactaacatatgataagtctgatccaaaaaaaatgcctaagtctaaaatcatggtagtcttcaactatttgcaaaccctttcccacaatcaagcaccaacatttgtaggtagtaaattcttcactctactaaagctcttatatatttaacagtt

SEQ ID NO: 9793 - DNA, 623 bp, artificial
  synthetic oligonucleotide
cctcacttattcttcaaggttctcagggacttgtgagttcctgcatctcgggtcagtagagggaggagtgccattctctgacacataccaagttgaggaccctgaatgaagaatgagggaagcactcacccaaatagccttaacaggatgtggctgaacctgatttctactccggaggtcttaagaaggtaaagaccatgatctgaggctggctgactcaggtccatagaggaaggattcctaatgtgtgccaggagtaaagtgagtaccctgaagagtgcaggaaccaccaaacccctatcagtggggatcccacagaatcctccctattgtcacctctgagagatttaggcatgaatgtcagaaagaggcaccctcatatcctcagtagtaacagagaagtgaaggtcttgttctgaggtgggcaatcccagctcagcaaagggaggaatattaagccttcctgtgagtgagatttaggatcctgagttaggacctgagtaggacaatccaccataagacctcaacctgtctaccacagctgccactcttgggagaccatggtcagctgtggccagataaggccaccctcttcctcctatctgatctcagggaggtgcagg

SEQ ID NO: 9794 - DNA, 2221 bp, artificial
  synthetic oligonucleotide
acttctacctcccaaatctcacagaatatgtctcttgtgactcacattaacctggacctatgcagagaaggaagttctgggaaacatagttccaatttggctaaggtaacaaacacaaatccaccacagcctttaagagcactggtcccactgtcagttgtttaggtgccagcctttgccacaagaatatgtgctccttaagagtatggaccacatcttactcacaatgatatggacaggaggcagggaaatactgggtagaaaagggcagggtccctggcgagggttccaccctcaagcctggacctgtggtcctaaatgagaacttcacttccccattttcccacctgaatgttgccttttggcccaccatgctcccatcctgtgcccgtaaaaaccccaagctccactggcagagcagcagactggtgtggcgtagcaggacagcacatggaagagagaagcagttgaacattgagaggaaaagaagcagctggatagtggaaactacggtcagagaggagtttggatatgaactctggacagtacagagaagaagcagctggacatcgaagactatggttggagaggagtttggccctaaatgacagtccatccccagccgaactccagaggaggaccaccttcccactttccctttccagctccccaacctactgagagccacttccaccattcaacaaaatctctgcattcaccatccttgaaatccatgtgactcattcctcttgggcactgaacagggacctggatgcaggtgcaagaggctgtcacactgactatccactgagctgtttaacatttacaccatccgcagatggccaagctaaaagagcacactgtaatacacgccctctggagctccagaggttgcaggcaacccttagacgctgccacaggccagtacagggttcattcctgccggtgcccaaaggcactcaccccggcccctgcaccagctcacctgcaggctctcccccacaaggggtttgagcgctgcagactgagtaagcaagccaccccttcacaagtcccatgaaggggccgagggaactatcccatctcaataatatattcctactgcttcatacaaaatctgacatataataaggactcacagatgtttgtcaaatgatgaatgaatgaacaaacaaatgaaggaatgaatggaaaaagattattaacaccattagtacattataagtactaaatatttggtcatataacaaagtaataagcagaaagaatctcctgtttttttccaaaggcaaaaaattaacatattttctatagactaatccccttaagatgaggtgaaactatttaaacctatcaaaattttatcatgtgtatagaactttcaaatgtacaaattgtgtttataaaagctaactaatttgactacttattacttagttaaatataacggagtcatcacttttctggacaagtatgaaagcaaaaatattttttaataagattcaattaaattataaaaataaaaataaatgttgacattatataccaatttttcattaaatttctttatatttatataaattatatttctgaacacactagctgataactaactgaagacaaatattgccaacatgtctttggtttcatttctatttatcacaacttgttctaaaattaattcaatcctacatcctctatttcagctgtttggcctactttaagcctcaaaggatcactatcatgattatcccataattttcagtctccaaaggcatcattatcgataacctcacctacctgtaatcacaacattaacattacagtaggacagagccccaactctatatagaactgcatccttcatagagaagctttaagaaaaggcagccaaagtaaacttattctgatccttcttctcatggcagcagaattgacaccttgccctgcataattatggtcacaaatagtcctcagaatatatgtaacctttcacttttcctaaatgttattaatttcctacaaaacaaaataaaaacaaaaattacacaataacaaaacacttgatccttcacatttgtcaaaatgcggaagtatgtgaaaacttttacatacatggcagtaatatgagaaaatttaattttactctaaacagactaactgtacccttagtaaacatggtttcatttctatttgaaatcatggaagcattctttattta

SEQ ID NO: 9795 - DNA, 666 bp, artificial
  synthetic oligonucleotide
acaacatattttggggggggacaagggaggggtgacagttaagtaggaatcaaaggagaaggggaggaaaatgaattatatctaaggataaagctattaaagctctgtttttacagagaggcacacagccaagaaggggtcaaaaaacctccaggctaagttgcccaaagctatgaaaccttccatttctagaaaaataaatgaagaatgaagaaaattatttgaaattttttccagtaatatttgatttcctaaacatgaaaaaaatgtggtcaatgttagagtattcttcagtacttaagtcttttagtatgtttttcaaatatgcgtttataccaacggcattttattcttgataaataaaagcattaacaagccaaaaaaaggtccttccaagacatgtactccaaaagtccctcttaaagtgaatgtatgccttccttttaagggagctgcagcaaatgagtcatcaattcacaaagacaccaatggatgcaatttcctgctcttgagggactcatgattatatggaatgatctatcccacccatcttggggggataaaaaggactttcgttcacatatgacatgacctgaactttaccagccctgcaaggttcaggagaacagcacacagcatatatgaaattataggtttgggtctttg

SEQ ID NO: 9796 - DNA, 2943 bp, artificial
  synthetic oligonucleotide
tatagtgcaaaactgaatggtttattaaagatgtttaatttgaaggagattttttacaagtaacatttgttttaaattattcttattaacattttaaaagattgattttgcatgatacaagaaggatggtggcttcctatattacagaagtaatattttagagaagtaatagttccagtcattgccacagagttctaaataaaatttgcacatggaaaattaagcatgtaaagcaattgcatcctcatgatttagctaagaaaatgtccaaaacagttaaggtcagtcgtagatttaactcagtgtttcaaaaccatttgattcattggtaccaaaagcaagcgttttacatttttctccaaatctttggatgttgttatttcttctttaagcaccataaatttttagctatgcatgcttactagaagtaagcaataagcaataacttattccttttcatctgtggcttatagaacctcttgctttgtgcatatgttttgcccctctatttcactccagaggttttgatcatatcaagtttcacttaataaagatgagtagagggcaaaaatcagtagtaactttggggaaaagtagaagttccccttaggcattgaattataatcaagtgaggaaaagctattattgatactcattcagaatttcatattagatcattgaaaatctttaggaataatgattgcggagtcaccgctaataacttaatgacaattgaatatgttaaaggctttgaaaaagataaaatagatgtagatgacaactcctgactcagatgactatagtaatttttcataattaccattcacagaatacaatttagatagaaataagagcaagagttaaatgcaatacggagtagctctaataggacctagacatcagggttaatttgaaaattatagttcctaaagtaattgtgttgcagaagcctatcatacaaaatataaaccatgaaataaaatttttatgaacttcttactaaagctgtttttatacccttgttttgatgatttacatttctaatttcacaactttagcccttagttgagccctaagcaaatttatgaaaacatatttcttattagagtacttgaaatcccctgtatgttactaatcccaaccaatgaataagaatttccattctgcaataaatatcattgctatcccataacctatgtttcacttgtacaagaaaatacttcttcagcacaaagaaggaatgattaattcttaaaatattaagaaaacagcctaataaagtctctcaaattccacttgtaaaagcagaaaaaatattagagtaaaatcgccacagattgtctcctcaaatcataggaacatgaaaattggaaactttcagcaaaatttatttttaacattgttcaactgttttgtatagaacatttaacgttaagaagcaattttgtggtttgaactatttgcatgataatttctggtgtggaagatgccttagagctgtgttgcttcaacttttcacatcagcacagtaacagtggggccaatttggtctctttatgtatatttcaacattaaagttatttttagacaaatctaccattggaagattattgttgcattggtggtggtgagtgagattcagctatgtcaaatctctccatttaaaaaaatgaggctgtcacatatttcaggacttctctgatgaggtgtcacagtattttgatttaacagactttgtataactatgtggatacaatagcaaaagtttattttcatttttttttttgtaaattgttttgagctaggtcagaatgatttctaagcatacacacgctaaaacaatgctaagacatagaaaacagcaaatttttcaggctattggtagatagtttaataagttcgtcctcttttgagaggtctagtcacctgtgtctagtgttggatggaaaggggcttggatccactggttagtcttccttattgtctcagagaaggagaaaagggctttatcgtgaagaaaaatgactgatggagctctatatacacaatagtataatttgaatttaataatcaactaatagtaccaaacaatttataacccccataaactcctaacacccgatcttcattttcactgtaataattctgtcgcaatacaaagtgttcatagttttttcttgtatttgtcaataagatggctcaattttggatgagaatttcaaccactgttgtttacagaagttaggattttttttttaccaccatgttgagctccttgaaaaaattaaaggtaaactttttgaggtgaggtagcctttgtgaataacattgcaactgaggaatttttttttttttttgagacagagtcttgctctgttgcccaggctggagtgcagtggcatgatctcggctcaccgcaacctctgcctcccgggttcaagcaattctcctgcctcagcttcctgagtagctaggattacaggtgcccgccaccacacttggctaatttttgtatttttagtagagatgtggtttcactttgttggttaggctggtctcaaactcctgacctcaggtgattctcccgcctcagcctcccaaagtgctggggttacagatgtaagccaccatgtctggccacaactgaagaatttgaggtcaaaatagtcctaatgaaggctatcattcttcagctctgcctttcatgaccctttcagtgtacatattcatctggttatattttcagtcaatttcttggctcacccaagaaaaaaatgcatatcttgttgaaaaattcctcgccaactattttccatcaaacagtttttcataggtcttcacagggagcgttattttaaatactgagactccaaggcaaatgaaacaaccaattcattatgctataataaaaccataagaaaaataacagaggtaatctgaatc

SEQ ID NO: 9797 - DNA, 2435 bp, artificial
  synthetic oligonucleotide
ttcctctatttagaagcccatgtctacccaaaaatagaaaaaaatgttttctcaaaagcccggaattagaacatcttacgacatcttcaactctaagttgaatttcattaaaatattttgttgcacgtttttgaagtggcaaacatcttgctttttggaaatctcagttttaagaaatgaaagaggtaaagagtatttgaattataatcattgtctaagccaggatcagttttctggggtgggagtacagagagatgcatcgggtagggggctagtggtcatggctaactgttataaaacttctattgatgccacccatttggatgacatgagattggatatgggctaagacttttgttgaaaggaacgttgtttacttggaagtgttccagtaggcatttgccagtcacagaatacaagaaagaaaaagggagtcattcattttatttcattaaaacatgtgttgaacatctactaaatgctgtaatctgtgctaggtgcagaagatataataataaaaccagccaaaagcgtgattctcatggtcgccagattgaaaaggggcttatcagttacggaagactcaatgcttccaaagctttaataccacccactttttattgaccgtttattaacccattttggctaggaaagggagtgaaagaatgtttacatgcatatttatatcactatttacataagatattttttctaataacacttgaaattgcgtttttaaattgttttatggaagaattttgagcccaagctggtacggtagcttactcctgtaatcccaacactttgtgaggcccaggtgagaggatagcttgagcctggaagttcacgaccagcctgggcaacatagtgggagcttgtctctacaaaaagataaaaaatttagccatgcatggtggcatgcgcctgtggtcccagctactcaggaggccgaggaggaaagatcacttgagcccaggagatctagtttgcagtgagccgtgattgcaccactgtactccatcctgagcaagagagtgatgccctgtcataaaataaaataaaatgaaatagtaatgtataccagcttttatttacctctattcttttttttttttttggtccaaagcatgtgtttcctttaattttttttctttaacttttattttagatatgggagtacatacacaagtttgttacatgggtatattgtacccaggtagtgagcataatacccaataggatgttttttgacccttcttccccaccctaagtagtctgtagtgcctattgttatcatgtttatgttcatgtgtgctcaaagtttagctcccatttatacgtgagaacatgcggtctttggttttctgttcttgcattaattcacttaggatagtggcctccagctgcatccatgttgctacaaaggacacgattttgttcttttttgtgactgcatagtattccatggtgtaccacattttctttatttgatccaccactgatggacacctaatgttgattccatgtctttgctattgtgaatagcatgggtgaagaagatacaagtgcatgtgtctttttggtagaattatttgttttcttttggtagaattatttgttttcttttggatatatatttagtaatgggattactgggtctgttttacattctttgagaaatcttcaaactgctttccacaggggctgaactattttacattcccaccaacagtgtataaacattctcttttctccgcagcctcaccagcatctgttattttttgacttttcaaatagctgttctgacttgtgtggatcatatcttattgtggttttgatttgcatttatctgacaattagtgatgttgaacattttttcctatgtctgttggctgcttgtacatcctttgatctcgaactcctaaccccaagtgatccacctgcctcagcctccccaaagtactgggattacaggcgtgagccactgtgactggccttgtacatcctttgaaaagtgtctgttcatgccctttgtggtttttacttgttgatttgattaggaatcttaagttccttatacattctggatattagacctttgtcagagcatagtttgcaaatattttctgccattctgtagattgtttactctgctgatagtttcttctgctgtgcagaagctctttaattaggtcccagttttcaatgtttgcttttgttgaatttgcctctattctgaaaaattctgtcacgtaccataaatattttgttgtagtaagttaggtaacacatttaaataattagctcaacatcctgaaatatggactactgccaaatggatacaagaatatatacaaagagagttctactccttgactgcccagtcaagttgcacacacacactgttcagatgggtccttggactatgtcaaatc

SEQ ID NO: 9798 - DNA, 1294 bp, artificial
  synthetic oligonucleotide
ataaaagcagctaacttataattcaattagagcctttccaatatttgtcaaataaaaaagagcaaatttcagtgaagaaaatcaatgaaggaaaccatttagaacatgcttattgctgtttgacttttgtcagttgcaagaaagggaaatagttgaaatattggcagtaaataaattttacagttattacttgtttcttctaattttctctcccttattgacttctcatttctggtaatatggcaataaacaatatgtaaagagctcagcactggatgtgattaatgtatgcagtatctgcagttaaaacattcttctctactgatgtctgtgtcatgatcctccttttttctcattttccttcaatgttgatttgcctcctcttaccttttttcttctgttattatctactttttacaactttaacaatgaccctgcatatccttcactggcctctctttcaaagaacccatcctacaaatatgcccagctacctactagacatgttcactggaatatgtccatgttaccctaacatctcccctcctttatgttgtgtcctgtctcctatccccttccctctaagtaaccaaaatcaactcattgcttttgattttctaattagttaattctggcacttaagtcaaaatcaccattgtctttgatttttgcctgcagacacttccttgttgaatatgtttgtgcaaacttctatcagataaatgtacctgaaacacacttctcattgtgtcattttactgttccacatgaatgtaaccattgttgatgtatactgggatgtggaaatgtttgggaagcactgatgaatgaattaacatgattacttcttcacaactatgtccctgtactcactggtgctagtctgctagtcttgaagatctggtgggaagaatagctctttcctatactgcacacttcttttcctgttgcggtggatattttctcaaaactttatcctcaggcaaatgattccacgtgcttacttatatccgtaaaatcctcaaatttcatagttagctgatggcaccttattattttattttggtgtgagaatggaaagactcattctcttatacagtttctgccatttcagtatgatttcatttgggaaataaagtaagataaatgttcttatttcagcattttatatatttttaacatctttattttgaaataattttcaacttagaagagttcacaaaataatacatagagttcctgtgtaccctttgtataacttctccaaattttaacttacataatcatagtacaa

SEQ ID NO: 9799 - DNA, 330 bp, artificial
  synthetic oligonucleotide
aatagaggttttttaaaaagtactaaatgggtataagaaagattaagtttcattggttgactctccaaatcgatttcagtagcaaccatattccttgcacggactatcaaactgtggtacctgctgcagagggattctactgatattaacttatgttggtgttaaggattagtcaaagttgttgtgaacatgacaaaatactaaaagcacttagcacagttgatgggatacaccagtaattttatagatgttgcccatttgtatattcttgtcaagaaccaattttgtaaggcagagcttacaaaagactgttccttgctgagaaggctg

SEQ ID NO: 9800 - DNA, 974 bp, artificial
  synthetic oligonucleotide
gatgctattaatttcaagatgcatcactcttttatgaaccacaaaggaagaaaagaaatgctgccaaattaacaatgatgttgttgatcataagttatatcttgatttcagagatattaaaatgggtttagaatgtatgtcttagaatagacgaaatatagtatttgttcagtaagtatggagtgcattctcaatgctctattactttcaacattgatatgcttcttttacaaatggtgaagatatgatagggtgtttgtgacacatgcttttctagcaatctgtctaaaacctagcatgcattgcaagacatgtcactgcaactctgcatgtgctaccacagctttccagaaggtaacatgcatcccacaaagcttccaaatttcttttcagaccgttttattggcctgatggcaagctaactcaaagcagtttgccatacacagaacacattcaccaaccttggtataatgttccctccgcttctttctaacaagtcacattttgccttttaaggttatccatcatccagtgttttaaagcattttgctttcaatgaggtggcacaaaaaaccatatttttacaatagccctaagttttaatggcaggcaaagagaatatgactacatatctcagcagacaattagagtaaggagggtgaggtaagaagagtggtgcaatggaaccgtgaagatagggagccctgaccctttcattttctgttccgtacatatttgaccttcagtcctgcaattgcagaaaacaaactgcccaatcttacccatgggacattttgtaattactttcttgtctcttctcttatgggtgcattgactagcacatagtacttctgctactgatagctcatatttatctagcactcattatgtgcctgacagtattctgtttcacatatattaattaaactgattaactttttaaaataaactttttattttgaattaattttagt

SEQ ID NO: 9801 - DNA, 1643 bp, artificial
  synthetic oligonucleotide
aatttatcaatttattgattacttactaaatacaagatactgtgcctgatgcagtatggaatataaatataaatattatatgagctctgccctgaaggactttgccgtttatagtacacagataaccaaatacaataaatatttcatgatggaataatagaacaaatgctagagtggattttcacaaaaaaatattgtcagaacacagaagagaaaaaaattttatttgagacaagcactgaatcagatttcacaaagagggtagaatttggtctgggactttaagggtggttgaaacatgtctatggagaaagggaaatggggtttggctgagatatggatacacggtggagagtttgggagggtataggcgagatgggagagtcttgatcttagaggataacacacgacaactcaaagtctttgaatgacattctttaagctattagaaaccactcaagacttttaagtaaggcagtgacatccgctgttccatatctaggaaaagttgttttagtggtatgtggaatagtttcaaggagtcagggataggaaatgaaaacaccatttatagggttcttcggaatattagcaggattgtaaaacagaggttaggcaaagaaggtgcaaaaccatctttcaaaattctggacatgtaagatattttaaagctcccaaaagtgaagttttgtgcaaaagttaggtgttgagctagggcagtaccaatgagaatgaaaagaaaagggaaaagcaagaaatgggacacacacacacacacacacacacaaacatttgagagataattggatgaaataatggccatgccacataaaaagaaattatagtacctgccataataacataaatttattccaaataaatcaaatgagtctaacttggaaaccacatcagtcatttatattattgtctaaaaccttttttgacaaaagtgaacacacatgtcaaaaatgttgatacttctcacttcagaacttagtccattttcacatttattcaagtctttatgtcgcaagtattttatttgtatgtagatttttagatatttatgattattttattttctaatgctgatataagtgaaatttattggtttgtcttaatattctgattttgtaaccgagttctctatttagttctaagtgtttttcagttcatatttgatatttttcagacaatcatctttacatgactgctttaccttttatttttcttgtgttataatattagccaggacttctaaagcaatattaactaatatttgtaaaaatctggctacttgtttttaacttaagctttcgaccactgagcaggctgttttaaataatcttcatttgataaagaatggattcctctactcttagttggttctgaatcatcaagatagacactgaattttatcaagtgctttcaatagacttttaatatttttaacatgaaatgtgcctttttcatgtcgttttctggagtaacatttatactagttttacaaaataagttaggaattcatctttttagtgctttgcagtaattttattggctttagaatctttcatttctggaaactttccaagtgtttattggtaaaattattgaagcctggggcttttcttagaggaacttct

SEQ ID NO: 9802 - DNA, 1542 bp, artificial
  synthetic oligonucleotide
caggcaaagggagacaccaataaattgaattctgcatcctggatcataaggtaagtgccgaatctgaccacaggatcagtgcttctgccactaaacccgagtatcatcaaccttactggttctttgcttagatactcttgtccaaagttcttaaacgtatcagcaataccatcatgcatctttcttttattattatttttatttaaataaaaagcctacagcacccggtattcccaggcactctcccattcaagtactaaccaggcccaaccctgcttagcttctgagatcagatgagaccagccatgttcagagtggtatggccatagactcatgaatcattcttaactagagagcaatacattttagctaggaaaactcctgcattcaactataatttcatataatgtaaatatgttttaactatattaaataacttctccaaatatgaaacacacatatatatcatttggtctagatggatccttgactgtaatttactttgctgaagtgtccatctctctatccacatttggattatttaaattacttggagagccaaggtggctcccagactaaaatttccccaattgtccttccactgctacttgttcatgtaggaaatttctccatcctgtacacagacatcagagtactctactccaaagaggccctaggatttttatctcttcccctttcccagtccttctgacaactctccctccactgtttaaagcagtattaaaattatccaaatgttcatcattgcctctttctactttcaatattcctctagcagtgccactaatctaaagcatatgctgatttctcttccctcatgaattatgatttataatggattagcatgagcctaggaacaatgtacttcctcttgtcccagacatgtttagagctttccaatttacgctaacattggagtttgtcatgggggcatttttgcccatctatttttattatattttagtcaatactgtgttatatttccatatcatattattctgatataaacaaaaatcacaaggtaaaatacaagtattcattattttcttagtatttatcttatccactgagtagctttgactatacttaaaaaaattctcagcttatttaatagattaaaaattataatctgtaatgaattaattggaaataaccaattaatatagtgagggaatgaaagtatgtcacaaaaatctttctgaaaatgtttcaacgacataagtacaaacaactctgagaagtacaaacaactacagagaaggcataacaaatatgtcatgattgtcaatattttaaattcaccacttcaggtaggacaaaggatgttaaaatatttttctttgaatatttaatatcactaataggaccaaaaacattggaatagcatgtgtgtgacataagctcaaagttctagagcagtgctattcaatagaattttctgcagtaatggaaattttcaatatctgcactttccaatatggaagcaactagctacatgtggccattgagcaccagaaatgt

SEQ ID NO: 9803 - DNA, 400 bp, artificial
  synthetic oligonucleotide
accctatttcaccttacttccctcaccctaccccaccttcttgcagaaacttattcctttcacaattcattatatttttatatgtatcattctactcaattttctctgtgtattgtgcttatatatgtttgcataaattatactctatattgttttctgtgcttcgtaattgtgacttaatcatatatctaggaaattgtttatgagtgtatatttaaatatgacatcatttaaagtaatccttgaaaatattttaatacttcttttagttttataaatagatgtgagtggttaaaaattcatcagtgtagaatggtataacataagaagaagccatcaaatgcttccacttccatctggcaccaccatttttatttccaggaataaacacatttgagac

SEQ ID NO: 9804 - DNA, 2113 bp, artificial
  synthetic oligonucleotide
cagtgacccaaccaatcaaataaattgaagaagtaataaaatgaatgcatttttatctgaaacggatgccaccagtaacattttgggaattccaatttaaaaggcccaatgccccccatgcaagattagtttttcaagatacttttacagggctaggacattaaaatatttgcttctctattggagcagctctttcaacaagttggaggactgatcacatccctttgccaattgcagttcagataggctctgggaaggcaaagtacaggatgtcatgcaagtgaaaacagaagtgattaatcttatggatagatcaaggaaatttatctgaactttagaagtgagacttgatgctaaataggtgtttggtgtatgaaaactaaggatgaagcattcctggtaaatagaaaggcctgattgaaagctctgagctgggaacacagcagagggaagcctactttggaaggagggattggtctggcaaagtgctggataacacaggttgtaggtcatataaaaccttgtagggggtttgagcttcttgaagcctatgagtgcaatgagaagccactgaaaggtttttagcaggaaattaacattgtttctaatttttatttttaggaaaataacttgctactaagtggtgaatgggagacaagagtgtctgtgaggctaaaggctgttcttgctgaagccccaaaatacttatttactctttcttggtgtaaatgagatgaaagatactacaggaacatcacatgtgttcaataactgcgcgagtgatatacttccctacggggacatgaacagtacttgaacagctgttaatgtctgttgcccttaggaaatttatttcatcaagcatacagtgtttcaacccttattaacttatttcataaggcataatatatctgactgtgatctgttcacttaatgctactctgctctttgcacgagcatgggacaaccagttgctctctgtagtcgtagtttattaacgtgcaattaaagacatttatcatatctctgaaaatgtctcttctcccataaaattaacatcatctcctcaaaaagatgcttacgatatatgctggattatagttactgttaaaatgtattcagaaacaaaaatagaattgaaaactatagaggaatttttttaaagcatgggctttggaatcaaacttgtgtttgaattctagttctgccacttaccagtcatttgcacttgagtaaggtacttatcccttctgaacttcagtttttcatctggaaataggcataatgacatctactttatgaagttgttggttatgtaaagccatctatgaaaaatggttagaccagtgactgacacatacgcattccataagtgatagatacataaataatataaataaaaaatgaatgctatagctgacaaatgtgattaaaaagtctacaatgcaaattatttttataaagtataaaatccatgtgaccatataatatactaggacaagaatgcctgttagatttcagattcaagacaacatactaagtttaagtgtagttatctttgctaggttagctttatgtatttgcatgaataattgtttaaatttgtctgattgtactacggactggcaggcaataaatttcattatctagtcttaaaatgtgaagagaagacagctcaaagttcatttctcatgcctgatctttctgggggatacaatgtacaacatcagataattcttttgccttcttttcttttgtgcatccagtaacagttatatcatttttttctgaatcagccttttcacaaaaccattatgtgataagctcttgtcttggaaaacctcaacagcttcctcaacacctatattttaaatcctgcttaaatgagattaaaatacggcactctgttaagctgtaaaactggctttttgcttctcagttgagtgttggtttgaatgtgtcatttgacctatattgctgctctgaatcttcctcggttgccccaatgatgacagtttcaatgatgtgggtgtttgcagcagagttgttcctaataaggaagtaacgctattgtctttcagacatcattcagcctgaaaagtactatttttcc

SEQ ID NO: 9805 - DNA, 491 bp, artificial
  synthetic oligonucleotide
tgttcaagtacacaccttgatcttctagtacaatttctctcagtttgagaaactgtaaagtaaaaataagttatttgtcacttacacacccaacacaatgattgaacaatcataggttaatcaaatcactatagacccttcagttcaaaaatgggggatactggaggcacacaggagtcactggtctataggcaattctgaaatccagccaggcacctgttgctagttctttgattatggatcagttttactgcctgggaatgattcttggctccactgtgtgggttcttcgttccgccatctgagtcatcctttcttttctattaaaaaatagctcgtgtttgcagcttggtagttttgcatcttgttttctgcccttagatattagggaccaaatggcctcctttcattttgtaatttctctgcctttttcagtacatgatgatataattcttttaaaatcattgtggagttcttacgaataaatttat

SEQ ID NO: 9806 - DNA, 1892 bp, artificial
  synthetic oligonucleotide
gatatacagaggtatgtcgatatatagatattttattaatcacttggatatagccacacaaatagcaatgtcagtgtcccatcttttaccatatataactactttctttcacttttctcggcctctgaagaaaatatcacttatgggaaaagtccaaggtctgactataaccatcttatgtaattgtttgactgtgggaattccagggtcatccataaactggcacctctcaatttccttgtatgccacagaagcttttgctataataattctactgtaatacttttaccatagtaatgaacaatcccgaaatgtcaatggttcatgaaaaatatttatttcctcatcatggaactctgggttagctgcaatatctctcttccaggtagtattcaggttcaagtgacttctccgccttaaagaacacctcttatccataatggagtattctcatgtagatgtgagagcagaagtgggatgacagaaacttacagcgtctcttaaagcttcccttcagaactgtctctacttagaactggcacattgtcacttttccccacattccattaatctattggccaaagtaagtaacatggtgaacccaacattgatgggatgaagaaatattgtactcttatgatcaggacaggtagagaagtaaagatgttctaaacaataaagcaatctattacatattttctgtccaagacactcctgaaaacttaatatcctgctaaattttcaggtgagggctgggaaccacagacaattggcagatttgaagagataacttttcaacaaagaaaaataataaaaggacgttgaaagccgtgtgttagtgagattatgaaatgttgaaagtttaagtaatcagcataccataaatgactaaaatctagtttcagtccagtatcttgatctattatctctactcaatttaatgttttcttcagcttatatcagtcgtgtatatctaacataccctaacaaataccccaaatataatagttttgaagttgaagtttaaataaaaataagtgatacgtgttcagtactttatcatgcttcttctctgaatgacaaaattaacactggaatttattttctcatacagaaatgttcgtgtcccaggcatctttctcagaagagtgtgagttgataaaacatgcatacaaagctgaagcttaggatgcagtttattgccatttttatttttccctgctttaattaaatctttcactgatgttgaaattattggtcctggaatgatccttgacaatgtctggaaaagaacacttaaactcattgttatgtagtgcttttgaactaactatcaagaaaagaatagctattacatgcattgcatgtgacaactaaatttttatttggtaactgcctcacggaggttaactcagaagatactaaaatgtctagagttcttgtctgctgacaatttagcttttttttttttaaaaaagaaatgagtactactacatccatcacttcataatatttttacatatatggaaaagaaacaataccacacattatctctatttgtgtgttaaataactaaagtattaacatttactttttgtcatcatgcagtgtgttcgttttcaataacagatgttttttgtttattagttttgctggttggtgtttttggatgttgctatggccactccaagtaagcgtgctaatttctcctttggtaagcttaaaagatatttcctggctcagatttaaattcaagactgcgtccatccaccaattccaagtatatcattattaaatagttcagtaatttttttctaaattttacatattgtctcttgagaatggaacattcaaagctaacttagagtttgctattagatttatagtaaagc

SEQ ID NO: 9807 - DNA, 1665 bp, artificial
  synthetic oligonucleotide
acatatagttaatagttaagtattattatcgctaatatcatcaaactagccctcctactctccatccattgcatgcgtgcactgcctatctcccctgtggagatacagttctatttcctaaagctgcttacaaaacaaaaagaactgtaatagataagttaagtaaagggtacgctgcatttgatttgagaatagagcgaatttagattgttaaaaaaaacttttctctttgatttcttctaaggactgtggtgcacagcccctaaggtgaccctcatgattcccagtctctgatatttcatgccctttataatcccctcccttagagtgtggataggacctgtgacttgctctagccataaaatatggcaaaggtgaagggactttgtggatgtaattaagatcccaaatcagtatatactgaaataatcataagggagagtacccaagatgtgtctgacctaatcagatgaatccctttaaaatgagtctaggatggtcctccctgaggtgacttgtaaaagtatgtggccgtgttgacaaagcctatgtggcaggaactagaacaggtgtgtccaattttttggcttccctgggccacattggaagaagaattgtcttgggccacacacaaaatacactaacactaatgatagctgatgagcttttaaaaaattgcaaaaaaaaaaaaaaaaaaaaaaaaactcataatgttttcagaaagtttacaaatttgtgttgggccccattcaaagccgtcccgggctcacgctacctgtgggccgcgggttggacaaacttgctctagaacctaaaggcagcctctggttgacagatagcaaaacctcaggaccctcagtcatacgggtgcaaggaaattaattcttccaacaaactgaaatggtttagaagcagattttttcctgtcaggcctccagacaagaatatagcccagtcaacaccttgattgacgtcttgtgagaatctgagaagaaacctgtatttctgacccatgaaaactgtgagataataaatatgtgtggtattaagctgctaaattggtgataatttgttacagagcgtagaaactaatatggggttatgctttatttcatttgtccttctccaaagcattaatggtgttgcagactagaagcaaagaataagacacttccatatggacgggaaggaaagaatagctttttagtttacatattagggaataaaacaatagagaaaacaattcttcagtttggacagtaattttcttgtaattaactttaaaccaccaagcaagttacctctgaccagagatttcttcatgtttagcccatttctttccctgaaatgcccactcctacctgttcctgtgcttcaacacaatgaaggaaattttttaaatgctgctgtcctaatgataacacagaattgtccaaatgtcttcatataaatggtctaatttgagttccataacaattttgtgaggcaagaacaaaacaaatgtgagattctcaaattcaggtggcatagttgtaaactcagtggtcatccatggttctgaaagcatcagaggccctcagaaagtgcttaaatgaaacagaattattttgtcagttgcaaaatattatggttctaagagaataaatgacttgccccgcaaagcct

SEQ ID NO: 9808 - DNA, 575 bp, artificial
  synthetic oligonucleotide
atcatgagatctactctcttcaattttgaagtataaaataccatattgttaactataggcaccatgttgtacagcagatctctagaacttattcatctagcataacgtactttatacccattgaacaactctcaatttcccccactttccaaccctgccaatcactttgtatacttttccttccatgaatttgactattatagatacctcatataagtgaaatcatgcagtatttgtcctatggctggcttacttcacttagcatattgtcctttcatttcctacatgatctagcaaatgaaaggattttcttttttttaaagctgaataatattccactagatatgtaaaccacattatctttatccattcatgagttgatgcccacttgggttttttccatatatgggctatttgaaataatgctgcaatgaacatgggaatgcagatatctcttggagatactgattttatttcctttgtgtatatgcacataagtgagattgctggatcatgtgatagttctattttttaattttgaggaacctccatacttttctccattatgactgtac

SEQ ID NO: 9809 - DNA, 3698 bp, artificial
  synthetic oligonucleotide
tagatagatagataggagagagagaaagagagagagagagagacagacagacagagacagagagatttgttacagggatctgggtttcccaattgtgggaactgggtaaacagtcttttaaaggttctccctccacatctgatgctggagcataagcagacctgacactccagcacaagttggcacagaagtcaggaaaagtaaagggaaattcaaagaagctagtgtaattcaggtctagacgctgcttcatgctaatgagatctgtcagctgatcactacatgttatctacaaaatggcagctgcttcctttccaccttccaataaaaatgtttgaggaaataattcactagtagcctattcaaattcctgaaaaaccaactatcttaactatgactcaaagtccaggtgcagtaaaagaaaggataacttctactgcttaaaattttaaaaactgcatgataaaaaaaagaaaaagaaatataggtaaagtaaaaaaaagactaaaatatttgcaatacatgctacaattaaaggattaatgtcttaataaataatctaaaagatgaagtttaacaacctaaataaataaacttatggaaaaattggcaaaaagacatgaaaaatttcgaattttaaaacaattttaaagttacaaaaattattaaacttattaaaagatgctaaatttcacttataatgaggagaatgtaaattcaagctaattgacaaaatttctcatatatacattgacaaaaatttgagagctcaatatcaccctctgttggcaagactgtagagaacagacactctcatatcttgctaatgggactacagaatagtacaatagtgtaattatgttgaaaaatttgacaaaatctaaaaaatgcctttgaactttgattcggtagtaccactttcaaaaatatagccagaggatacactccaaaaatataatatcaaaaggacaggtaacaaaagaataaatagacaaattaaactttgtggaaatttaaaaatttagtatatcaacaaacaacatcaacagagtaaaaaggcaccccaaagaatgggagaaaatattttcaaaccatatatctgatgaaagataatgtgaagaaaatgtgcaaagggatgaacaaatatttctccaaagaaaatatacaaatggccggaagcatacaaaacaatgctcaacatcacaaatcattaggaaaatgcaaattaaaactacaatgatgtaatacttcatactcatcagggtagctactataaaacaacaacaagaagaaatatcaagtattggcaaggctgtggagaaattgtaacacttgtacatttttggtgataatgtaaaatggtataattgctgtggaaaactggtgttccttcaaaagtcaaaaataaaattgatgtatggtccagcaattccatttctagatatgtaccccaaataattaaaaacagggcttcaaagagctatttatgtactcatgctcatagcagcattattaacagcagctaaaatatggaagcatataaagtgtctgtggataaatgaatagataagcaatatgtgatatatacatacaatagtatattcaaccttacaacggaaggaaattttgtcgtatgctacaacatggatgaatcttgaagacataatactaagtggaagaaaccagtcacaaaaatacttatactgtaccattctacttatatgagatatttaaagtaatcacagtcatagagacaaaaagtagaatggtggttgccagaggctggggagaggggagaatggggagatattttttaatgtgtggagagtagaatgctatagagtttcacttttacaagatgaaaagagttgtggagatcgatggtgatgatggttgcacaatgttattaaggtatttaagattacttagctctgtgcttaaaatggttactttgtctataccaataaattggagaaggaaaataattttttgttaagataacaaattttatattatgtgtattttaacataacaaaaataggaaaaaataataagcaagcaaaatcctgataacctaatagaaaacaggaaaaaaaattgaaccaacactttaaactcctcctgcccacccaccacagtaaaggaaaaaagtggcctatagccatatataaaataggctcaaatcattagtaatcaacaaaatgcagattaaaattatagtaagatgtcactaaaatttaagaaacgcaaacgtacacccccacacccatacagcgtgtataagataccaggtgtaggctaggatgtgtgcaataggagttctattaagatgctggggcaggcactgtggctcacatctgtaatcccaacactttgggaggctgaggcaggaggatagcttccatccagaagttcgagacaagcctgggcaacacagtgagatcctgtttctacaaaaaataaacaaaattagccagatgcggtgtcagatgcctgtagtcccagctactcaggaggctgaggtgggaggattgctgagactgagaggtcaaggctgcagtgagctgaggttgcaccatgcaatccagcctgggtgatagagtaagaccttatctcaacaacaacaacaacaaaaaaaaaagatgttagtaagaatatatgtttaaagtattttgaaataaaatttggtattatctaccaaatttgaagacgtacatcacctgttactcagaaattctacttttacatctctattcaacagagtgtaggcatttgtgcaccaagcagtatgtataagaacatcatttgggaggccgagacgggcggatcacgaggtcaggagatcgagaccatcctggctaacacggtgaaaccccgtctctactaaaaatacaaaaaaattagccgggcgtagtggcggacacctgtattcctagctactagggaggctgaggcaggagaatggcgtgaacccaggaggcggagcttgcagtgagccgagatcgcgccactgcactccagcctgggcgactgagcgagactccatctacaaaaaaaaagataaaaaataaaaatatataaaaagaacatcattagcatcattacatgtaatatctcaaattggcaataatctcaaactcatttaaaagtaaaattgataaataaattgtagaaagtcaaacaatgaaatgctaggaaacattaacataagtgaattagtgctacgttcatatttcccactaacataatgctgactagagcaacctagatacttctggattattccattcaggtaacatttaaaaatcaggtacacttaaataacgtttaatgatatgtactgaggaaataaaatcacaaagaaaagaaggaaataactaccatacaattctggttatctttggcagagagaaatagtgattttgacagggtgtatgggagttatttgggttgatgactttatttcttaagcttgagggtcatcaagcagaagttcactgtatgagaaagggctgtactgtatatttctactttgtgcatttcccccatgtatattgtagtccaccataaaatttaattaaaatgcaaagtagttggttaaaacataattctgtaatacttggaattgctccaattataaggaaacacttttgcttagaacaaggaagttataaatgtatttgctggtgacaagagat

SEQ ID NO: 9810 - DNA, 913 bp, artificial
  synthetic oligonucleotide
aagttatttttacaagaatgcacattccgctccaagtactttagccattatttttcaggactttttgatatatcaacatccttggaaaaaatcctgacaataagacagtgccttagttgcaataatgcagaaatttgagacactcatcgagaaatattcacccaacaattaacaaacgggtttgtaaaatgtagcttgtagggttacaacttccacagtacatagtatcgtatgaaatgtcaataagtaaactactgcataccagatgtaatctgtcacagtttgaaagatggacagtttttgactgctacagtttgttgaatggcttagatgaaatagagcagtgaaaatagattcatattaaaatatgtatgatgacataaattaatatctaagctattttaaataaaatataggccagacagggtggctcacgactttcatcccagcactttgggaggccaaggcaggaggatttattgcttgaggcaaggagttcgggaccagcctgggcaacaaagtgagaccttgtctctacaaaaacactttaaaattagccaggtgtggtggtaggtgcctgtagtcccagctactcagaaggctgaggcaggagaatcatttcagcccaggatgctgaagctgctgtgagctaatacatgatcgcaccactgtactccagcctggacaacagagtgagaccctgttctaaaattaagtgtgtaaataaataaataaaatatgtttatagttatatacccacatccagatgcctacttttagatatctcaatgaaattaatggagtggcttacactcaacatccacatttggaagaactcagtttttcaggcaaaagagttttgctattttccagttatttattgagaaagaggatataataaatacatacattt

SEQ ID NO: 9811 - DNA, 1052 bp, artificial
  synthetic oligonucleotide
aaaacaacttcctgagaattcagtataatggccaattaatagtctttgataatagaggaaagtcttaattttatctttgaactgtagagagttttgttggaatgtaacaagtagattcttttctatatgggaaccaaatatgtctattttaagaaattatttttagtgcttcagaatatatattagtttggccagaaccttgtagtctaaaatcggccactctgctaatggttttataatgctctccagctaattggaaaaaaaagtaatagtgttgctcatcagcaatagtaagcattagagattacactctgtgatcttggtaagtgatactcttaatatataaaaatactcatgtgtttgaatttttatcatatcctaagtaaagaaaccataacgatcgcattttattatttattttgtctttcatcaaataaattcaaaccagtttccttagaaagtgtccctattttaagttcacctttgttataacatttaatattttaaaaaattttgtgggtacatggtaagtgtatatatttatggggtacctgagatgttttatgttatatcaattttaaacatggtacttttgtttaatcaatagaaagttaaatattacctaacaagacatgaactctcatgagttagtaggaaacttatagtctaaaatctagctcatctgcccgtttactctttatctttcataaggaaaattaagtcaagagaatatataacttccactataaaaatgtttgagaaatttacaaatatatcttcaaataattcaggttttcttattgaattctatgtggatgctcttcctttacaagtcctgtccacagccaacccatagacttttagctttggtactctcactggttgatctcacccatgatgtagtgagtccccttctcagtatgcatacttggttcctgaattcattcccactggttgacctaaactttccacctaactgatagggtagcaggatcaaagagcatgcacgttacagctaagcatttgtgttagatgcatatacattattttaa

SEQ ID NO: 9812 - DNA, 7355 bp, artificial
  synthetic oligonucleotide
ataaaatcccctagtgtttaaattaattaaacttgtttctttatttgattgttatccttttttatttcttccttaaattcctacgatttccccttttcttagcacaggaaaattctagccactagctagtcacaacttaccatattattattatttacatgttattattatatgtatttggcagattattcctttccaaatgaattaatgccacttctcttgaaatttcttttatattatgtatatatatcctacagcatctaaatttattgtttgctttttgtaaacactagtgacaaaaaataaatactcataacaggctagtccaatggaaactgaggcctaggcaggtaaaggtatggtcaagttcagaggcatgctgaagctgagctaacactgaaacccagttgtcctggttccaatttagtattccatgtatcactcctattgtgttacattaccattgctatgcctttgaaaatactggaatgtaagagtaatgtattgctttttatatttaaagttactgtaatagaaagaatgaatgagctgtaaactctgttgattttgacttagtacactgaagacatataggcgggcccattcatactgcatacccactcttggcatagtgcttggtatatgcgtttgttaaataaacgataagcagaaagtaatccctgaattgaagaaacaacatgaagacattaatgatgaaacaacagacactgtaaagttgaatatttgaatgcagccttccagttagggaattaggggcctgaattttgcctactgaggcaaatattccattgaaatcgttgctttatggatgccagcagccactaagcacaattgcttcaaagagaataatttttaaaaaatctacagcagtagagattttaaattcttttataccccatgattttatcttcctgtccttttatttcataatatatgtgtgcaacttgggagttctagctactgttatggtcagaaattctgcaataatttattttttctaggcatgataggcagaattttaagattttccccaatgacccgcaaccctgtataatcccctcccattaagtgcaggaagtacctatgaatatgataggatatcacttgcatgattaggttatgttacatgacatagttgactttaagaagtgaaattatccttgatggacctgacctaatgaagtgagcccttaaaagtggcaagactcttcctgatgaaagggattaaaattattgtggattctacatgaaggagattctccattgctgactttgaaaatggagaggtccatatggcaaggaatgtaggcaacttccaggaactaagaatggccccgcctggcatccagcaaaaaaaaaaaaaaaaaatggggacctcagtcctataaccacaaggaacttgattctgccatcagcctgaatctttcaagtaaatctgtgcctgctgcctcctgataagcatgctgcccagtcaacaagacactctgagactgaggacctgagcagagaatacagatgaactgtatcagaattactgacctacagaactgtgagataacaaatgggtgttattttaagccaggaagtttgtgataacttgttatgcattcacagaacacttaatatattgagaatctcaaagattgggtaaatacttttttagtactttctcaaagtttcattccaataaatatttataagtaactagacgtctgtaaagtttacaaagtgttttttcatatatattttaatttaatcctcccatcaactcagtaagaataatatccttactttccactctaaaatttttataagacatatatagagtaatgttattgctcaatatcacaaaggcagataataaaattatggctaaaatctaaaacaaatggaaataaaagtaaacaacaaatgaataaaacaaattaaaaataatataattaatgatgctttttaaaatgtgtggccagaattagcattaaagatttaacactcaccagggctggggctaggatgaggcaaatgaggcatttgctttgagttcaaaatttaaagtaagggaagaccaaaaattctcagtaatcaaaagagtaaggtttagggaagaggaagtcattagaacttcagtcatttattggcagcatgtccactgaaatggttaaaatgttattgaaaacagaaggtttaaggatgagcaattagtccaagtcagactggagcagaatcaaggtaacggtgaatgaagtcttcaaccactgaacggctaaagtttttgccagatcactctggagaccttcttttgtttgagaagttgtagttatatcattcagggagttacaggatgggtaaggtaacagggagagagggaagttatggtagataaaaagctctaaaatcaattctaacagctgaatggtgataaacctaggtttgtatttgtcttagcctattttatgttcctataatagtaaaatacagactgggtagtttataagaaatgtatttcttacaattttggaggccaggaagaccaagttcaaggggcttgcatctggtgagggccttcttgctatatcatcccacagtggaaggcagaagggcaagaaagcacaaacaaaagagagaggaaagggtagtgaactcatccttttattaggaactcactttcataataactaacctgcgataatagcagtaatccattcataggagcagagccctcatgacctagtcgcctctcaaaggtcccacatctcaacactattgcttaggggactaagtttctaacacgtgaactttggggaacacactcaagccataacaataacctgagactccttactcatagtttaatatctttgctccataacattctacatttctaggcttattaacccagaaacatgtcataaaagttacaagctcaagaagtaaatattcattgaacaatctaaatatttcatttagtaacaggtgaattgagaagttggaaaatttcttttaataaattgtgacaacatattagtatatttattcaaatacatgaatatttctgcatttaccacattaatgaaaagagtcttgatataaagttcatttgaatagccatatattgaatcagtttgtgaacccagagggaagagtgccacaattgttttttaggtctacacacatgcaagctaagataataacaaaacttgtatcacttaccatatccacattacgatttgtaaagataaaaataaaacccagttggcctactgactggctagctatataggaacaacacagaaaccttcaaagaaaggtagctttgaagaaatcatagcaacattttctgttttccaaaattataactatttgtaggcacaagtaatgtcatgtgacaaacactagggcctgaacattatttattccaacacttctaactaataatccttaataagagattaattattcaatgggttatgaaccagattcattctccagaaaaatatttttgtaactcaaaattataaatatgtattaaaaatttttggactaaagagttttctcatatcaattagacaaagattttgttttatttattcctctgggcaataaaaaggcacaccttaagaatagcaaatgaaggttaataaaatattctacctctagatctatttcagctaataatctcaaaaggaataatagaattagagtattataattctgcaaccagtaacaaattgatgaatgagagcgatgatccttagtgactgtaccatcaccacaaaaaatgaacacatgctatatatctcctttttttttttttttttttgagacagagtcttgctctgttacccaggctggagtgcagtggcacgatctcagctcactgcaacctccacctcctgggttcaagggattctcctgcctcagcctcccaagtagctgggattacaggtgcgtgccaccacatggggctaattttttatatttttggtagagatggggtttcaccatgttggccaggctggtctcgaactcctgatcacaagtgatccgcctggcttggcctctcaaagtgctgggattacaggcgtgagccaccatgcccagccgctatgtatctcctaatggaagtgtacagcatcatctctggagtggtcttacccacagattaataaataaataaaccttaatctgaacaagcttctccctataactattgaagattatgatgctgaatgtcaggtatattgggttattattctattttctgtaatgctgtatacaattgagaatttatataattcatgatttattataaatatcatgactttaaattggaaaactcaagtaaaatgaaacaatttttaatgaaatataagttgataactaggttcataaagaaatagaaaactttaatcagatagtacaagcaaaacgtagtctagccctgggcacccgcaaaatcttccaggatcagccatgtttggaagcccattacatcaaatcatgaaggaaaagtttatcaccacattaaataaactcttacaaaccatacaagaagatgggaagctattcaaccactttagcaggctagctatacttgatacaaaaactagatgatcatatcccaaggaaagaacacttcagccaaatttactcacatagagacacattctaaataaatgtatagaatatctaatacagcagtgaataatacagcagtgaagaaatagggaaataggctgtgtctaagaaatgcaaagatgatatcatattaggaaaaatgtgaattggaattcactatgttaacagagaaggagaacgcatttgatcacatgcagcagtaaaggaaaagccactggtaataactgaacaccaattcatggtaataacctttagtatatttacattagaatggaatttccatatcataaaataaacagcaatcatactatttgaaatgttggcagcattctcaatagttcagaaccagatacagaggtgtggtgccaattctgctggtcaaactcggactggattgcggagccagtatacaggcacacagaagaatactaagataaaatttatgaaaaatgaaaagaaagagaatatgattctctaattaaaaattctaaagaaatcagctcacaaaatattcaaatgtataaggaaattcagtaaacttgtgtagaaaatcactatagtgaaatcaggaatctagccacatgaaacaaacaactaattagaaaatgtaacaatggggtgggggttgggggaggcagggcatcaagaagatgaatgctggctaatggatgctgggcttaatacctatgtgatgggatgatctgggaagcaaaccaccatggcatatgtttacctatgtgacacgtgtttacctatgtgacacaaaccaccatggcacatgtttacatatgtgacaaacctgcacacgtaccccagaacttaaaagttgaagaaaaaaagagaaaatgtaataacaatcccattatgtgggcaaaggacatgaacaaacacttttcaaaagaagatatacatatggccacaagcatatgaaaaaaagctcaacatcattgatcattgatgagaaacgcaaatcaaaaccacagtgaaataccatctcacaacaaataactaattagaaaatgtaacaatgtaaaaaatagaatgactattaccaaaaagtcaagaaaataacagatgctggagaggttgtggagaaaaaggaatgcttacacactgttggtgggagtatgaattagtttaaccagtgtggaaagcagtgtggtgattcctcaaagagctgaaaacaaaactaccattccacccagcaatcctatgactgggtagatacccaaaggaatataaattattctatcataaaggtacattcacacatgtgttcattgtattactattcaagagagcaaaggcatagactcaaccaaaatgtccatcaatggtagactggctaacaaaaacgtgacacatatacatcatggaatactatgcagccataaaagaagatcatgcccttttcaagaacatggatggaactggaggccattattcttagcaaactaaaataaaaacagaaaaccaaataccacatgttctcacttataagtgggagctaaatgatgggaacacatggacacatatagcggaacaatggatactggggccttttagaaggtggagggtgggaggaaggagagggtcaggaaaaataactaataggtgctagacttaatacaaggctgataaaataatctgtacaacaaacccccatgacacgagtttacctatataacaaacctacacatatactcctgtacttaaaataaaggttaaagaaaaagaagcctcaaggaatcttgtaaaaacatttgtgctacctcaagactttaagtcatgaaattcactgtgaactggattaggatcttacgcgaggggcataagtaaagcttttcagaaattcaaagctgactcagccagtgtagtagaaacaaaacaaacataatatacaaagcattaaattgaaagtaatggttccaaataaggaaagatcctagctacttaagattttctctgagaagttcttttctggattacttttagtgcctgaatgaaagatcctttgatgtttctgtcatcctcatttttctcctaatgtaccatcctgaaaatctatttcaataaatttgagagggctttaaaaataaaaaaaaatggaatgaaaaatataccattcaaaagagcagcaacattcaaaatatacctaaaaagaacattcacaaaaacatacacactctatcaaagcaaatataaaaatgtgttgatagacttaggtggatgcctaagtacagcaatacaatatgtttatatatggtgaacataatattgtacagatgtcaattatctttatttacagatttagtgccttatttgatggcctcaagtcagcagagaagtggcccagcacctacaaaaagtcaagataagacactgagtgaggactgagggcattacctacccaagaagagggacccccacagagccccgcccctactgtcaatcttgggagtccccaggcgtggctgctgggctcaggttccaccttacttcctactctggactcagggaaatgatcctttttctgaggctgactgattcagcttagcaaagagagaagtcccagtgcctgcaaagtcaatgaaagaaatatatgtatttctttaagaactgcccctcccccgaacgcagaaccatttgccgttaagctgggagagcaaagtgggcgtggccggacatgtttctct

SEQ ID NO: 9813 - DNA, 629 bp, artificial
  synthetic oligonucleotide
aacacagaagtgaactataagcagttttccctggtattccttttgcacatcttgtttgtcactctgtgcttgtttgcttattttgtttttgcctttgagataggcttcccctgattttcctaaagaaaaaatatatggtagatgatttgtcgaaaacaactcatagatgttgactttatgtttagcagggttagccattctttctctcagtctgactttaaaattcccatggaaaagagcatggttgacccaagttggatcagggtccgatccagcactgatcatctcattccagagtacactagaaaccaagtttgtgtcagattcctttttcccccatacttaccttcatgcagcagttatctggaataaagtgaaaaggtgaaagtgttagtctggagatttgaaataatagttggctttcttgttataaaccagcttattccttgtatatatttttactatttccaaagacagaatattgtaccttaaggcttatattttctagagaagtatcaattatttgtttatggaggttgtctgttcagcttcagaaaaggttgcatgaggaaaaatactgtctgtcaaagtcaaaatataactgaataaggtacagtcacaagagaact

SEQ ID NO: 9814 - DNA, 1360 bp, artificial
  synthetic oligonucleotide
ccattcaggtgtaccacaagctttcagaaagtcaatagtttaaaaaaatgtattgattgttactaggacccttagagaatggccaagaattttccagttgatcaaagatgacattctaagaacaacaaacttttccagacaggttataatcaccagagatgttaaaattatgtttaaaatgtagtggttttatttggaaaggaatgaaagagtaatcaaagatagtacatgtattaacaatcacaaaatgattctcctactccccaaattaatttgtttactgttaagaataatttgatacaagcaatataagataaagacaacttttcaagttataaaatgaaatgtcatgtattaatacacaatgcttgattctgagcacattatattgaaaagaacaagaagagtcagacaaggctgagatcaaagctctttgggccagttattcgtactatgcccctgagaaatttaacctctttaagtctgttttattctctgtgaaatggagatactatttcctatagtatttagtgagtacataataagagttatattccttaactttccatgagcatttattacaggttgaagaacagctgcctaatttgtttgtctgttatgcatagggagccccagaggcatccaaaacttgaaaaaaaaatctgctattctttatgtggaatgctgtgattgggttctcagtgggaagcaaaaggggacagagtagatggcttctcagggcttcttgggactagggtgacttagttactgcaagcaacttaagcatctatttcttgaataatgcctgcgcagagcaaggcaacactgttcctttccactttgtgtttcttctttggcctctgtctcatggtctatctgctttaactgagccacctccttcctgattaatgagtccaatgtgtttgctgccatgcactctcaggagcttattggtatgtcactttggattacaggaagcttcagtgatatataaagtgcacatgtagtaggaacttctactttaataattgttactcaccagcatttctgcaccatattatttctaagcaactaaatttaagagtgcaagggagttacttagtcatgttaaagagtatcagagttctaggttttatctatgacatcacggcaattctgagagacggattcatttagattccctgggttatatattttgtgcacataaaatggatgtatttgccctctcccagatttgaatgacaacgaagaatagccaaatatactgcaaatgaaaaccacaaattatgtaaaatataagcagggctttaaattctgaggctttattagtcagtttatatatcctcacttggacaccaaa

SEQ ID NO: 9815 - DNA, 1273 bp, artificial
  synthetic oligonucleotide
ccaaatgagtgacctttgagttctgggtaatgagaagggaaaacatggttataaaagattagccaaaggaaagggaaagcaggatttaatagaaaaaaatattagtgtgcctgaagaaaatatattatggattttcttagaaaggaaaaaaatgaagaaatagtcaacattgtgactgatttctttaggaaagcttattgtatgagtcatattatttgaagagtaaaattataaaggcatttatagtcagtgctttttaaagttccagaatatttgaagtatcagatgttcattgttttttttagctgtcaataataaagagtaaatcaactacataattaataatgatgttttctcattctcagcaaactgtcgcaaggacgaaaaaccaaacaccgcacgttctcactcataggtgggaattgaacaatgagaacacttggacacaggaaggggaacatcacacaccggggcctgttgtggggtggggggaggggggagggataacattaggagatatacctaatgttaaatgacaagttaatgggtgcagcacaccaacatggcacatgtatacatatgtaacaaacctgcacattgtgcacatgtaccctagaacttaaagtgtaataaaaaatatatatatataaaattaataatgatgttttctaatggctaggcattgttgtgagtgattcaataagtgatttttatcccctcaataattctattgttattctcattttacatttgaggaaactgaggcacaaaaagttttgaataacttgcctgtggttacacaactggtaaggagcagacctaggatttgaatttggccaatatggcttcagaacctgcaagtctaacctctgaattaggcctctatttatattgtgcctaaatgatgaatgggtagtagcagaaactgtaatcactaattttaatttaaaatatatttaaatcaggtatgtgaatttgaaaaggcaagaaggacagccaggagagttgaagagtggataaatatattaagacaggatggtatacaaaatgatggtggaggtttttatgtgaaataacttgtgttcatccttgcatattgcttagggcagcactgtctaatagaaatataatgcaaagcacatatgtaatttaaattttgtagtacccacattaaaaaagaaacaggtgaaataacttgataatatatcttatttaaccaaatgcatcaaaaatgttttcattgtaacatgtaatcaatacacaaattattttt

SEQ ID NO: 9816 - DNA, 1025 bp, artificial
  synthetic oligonucleotide
acacctgtggagtgtctctctattgggcctgcaaatccttcttaaagtcatcgtcccacaaatctctactcagcccacacagttctcatgagccttgctcacatctgccaagacttcactgctttgcattttgcttccctcacagtgtctggcaggccgcctggatcacaacaggctttctggtaggtatttgctgatttgatgtgagttgttccttcaactccaagatatggacatcacacatatggcttgtggagagttgtagtaagtcctgctatgatttccaaagtcatttctgaaacattgatgaggatttacacctctgggctgagggaacataaacatcgacctgaactcaataaattcaaagttctcctctcaaggacagttcccacagaacttcaactcaactgaagtagaagggaaggcagattattctgtttatttattacagttttcacttatttatgtgttttttttttactggaaaaagaaagagaacaggataaaatgaatataaaacttaatgaattattataaggtcaacacccttttaaataccacccaagtcaagaagtcaagaaatagaatctcatgtcacctaagaagtcccaaggccaaccaagtgtcgcattccaacttcaaccacgtcccttctccctatgggacttttgcaacaatcactttcttccatttctttgtaattttatcacccaactgtgtacctgtaaaccctatagtttagttttgcctggttaaaaaaatgtcttctctatatattttgatccaaagattcccccttcttccctgcctcttttcctggaaatttatttgttgaagaaactgggtcatttgatgtgtgacatttcccatagtctgtattttgctgattgtatacatgcagtttagtttaacatggtcctctgttttacctgtggaatgctagttgtaactagaggagtggttttcaaccaggggtgatttgcaggggacatttggcagtgtttggagacatttttgatttt

SEQ ID NO: 9817 - DNA, 1704 bp, artificial
  synthetic oligonucleotide
agtcattgttttgtgttcatgttttttttttggcatcaagtttttctagtagttccagacatttttgcccccttggcaaggcataggacattggaattcccatctccatggaaatggaaaaacaagcaaacaaacaaacaaaaaacagttctcatttgcaccatggctcaataggtagaaatggaaaaaggatctcatgatgctggccccacagataatacagactgtgtctgcattgtaccacaataaagaggctgctgtggtgcagctttctgccttctaagaagatcctctgctcttacagttgttgagtgtgcctggagaagcttcagaaggttagcaagtacctgtgtaagcaagagagagaagactgaaagataactcaggaaattcttacaatggtgcacagagaaggaggcaaacgccaagtctctagtttgtcttcagaacaatgtagagagacataaatacaaggagagtaagggtgatgcccccttctgtcaggtgactggatatgtaatcagcacttcctttcccatgtcctgactacctctgagcctggaaatgggagataaggatgcaaaacactgccacctggtcctcagcaaatgggtaaaatgggttgggctgactgcagttgagctgtaagagcccttaggaacagggttctccaaagtcaccattttgctttagaaggtttattttacatttcttaaaataacacggtaaaattataggcaacacaaacaagatttgagctatgttagtcttttaattcaggcagaatttaatgtgtaattaagattaattatatcataatggaattgtagacacatgattattgcatcatattccttgcagacatgcatcttgctttcacatcattctggtttctcagattgagaagcatgctgagaggcagagccaatggaatccggctgcatttgcaggatgtgtttgctacagggtcgttttgggagttaatttttgccaatgttcatttcagaataattgaaatatgcccaactgtgatggccttttaaaaatatcctgcttttttgtctgttttgagagaaagccaaccttaaaatatctccattagaaaaaaaatctccattagaagctgaaaggatttgtgtgtgttgttaagtttaggaaatcacctgagtgtttagattgtgtgtgaaggtaaaaagaatttatttctcactcataaattcaaaatacgggagggaatcccatctggaaatgttctagaataggccacttcctgagtcagaggggaagatggggtaaatctttatagatagttttgactctcctatttaaaagagaaaaggaaatctaaagaaggaaattccattatatactatagcatattatttaggtatatgacaaatacggcaactttgagtcaatacttaaatctgtgtaattagacccagagggtttttttagcttcatattcttggctgttatttcaactgtaaaagggaatgattctcaaaagtgaataatatacagatctttaattacttatacactttttattatggaaattttcaacatacatattcagaaccttttaaaagagaaaacatttattggagcccagtgttgacctaaattatttttattatgtgctaatatatgatcagttataactccttctgcttacagcttttatacaagtataaaaccaaa

SEQ ID NO: 9818 - DNA, 20149 bp, artificial
  synthetic oligonucleotide
gaaaaaatgacttaaaaaagagttcattaacaggaagaatggtactgtttctcgtataccatccaactagcagcctagaggggggaaaagaagccctactaaacaaaaaggcaaaatcgacgcaaaattgatatcgaccacaacacacacacacacacacagacacacacacacacacacacacccaactcctttccctcagtcttctccagcagtcccgtctcctccccaaactctccagcggccctgaccaccccaggaaagcggctttcactcagggagagcctgtggatgtggagtctgagggttttagactctcagacctccagtaaggccctagaaagttcccaccgggcctactaaacccgggaacggagtgtgtggtaggaatggtagttggcggccgctccccataccccaggccggggcccttcttgcgagtgccgcccccgtgagtccagggctagcgttgggtggcggtgatccacccgacgacccaagtgccagaagcggccaccagccggcgagccggttccgtgagctctccaacgtttcgggcgggcggggtctccgggcgtctggacccggggttggagaggaggggattgaagttgggggtgaaggggggtgcaggataggaggcgagcccgggacgtgcgggctccagcgccgaagctgccgggcgggctgcccacacccaggtgggcacagcgcctggcaggccgctgacctctgcccaaccctgcaccctcccctcggccgcgcacacttgcgccctgggccgcgaggggacccggcccccctcctccagggcgcgcgcggagcccgacggccccagcccagagaggcacccgcgccccccgcggcgaccgactggccggcggcggcggcggcgtggcggggctgccggccccagctccgcaatcgcggtagtcacgccgcggcacccccgcacccctcccgcctgcccctctccccaaaggtccggcgcgctaattacagcaaattgaaactaattaagcttctcttccctttcccatcaccctgggagcgtcggcgagacccagcccccgcgggcgggcttccaccaagcggtcacccggaggggcgcgggcagggcccgggggagggagaagctgcggtccccgccgcgaggagggaggcgtgcgccgaggtggttaaggattgcaaatctgtttgggtctcctcacgaaatctgagttgtttagatttttttaaatgtatacatttaccaatgcctggataagtgatgtaatgacatttgtcgagttaagatctgccatttggatacccctcgctgcctttccatcactactgctcccgcatgtttctctctctctccctccctctctctctctctcacacacacacgcacacacaacacaatacacacacacactccctcctccctgcgaacatgccgtggagcccgccccctcggaagggagcgcctgggcttctcgctctcgccattacctgtcatctcggactgcgcacttcacttcctggctacgtggcactttccaacagctcccttcgccttccgagccaagactcccgcttgcttcaaatttctgactccaccgtcaacaacgcccaccatccacccacccatcctggaacccaccccacctccgtggcccgggacccccagctcccgctgtgacacgacccgggagagcccaggtgcgcgtggaaagtaccgcggcggcgtccttaaccttcgtaggaaatccggttccctttgaggatcggattcaaaccaggggcctctgccaggaaaacgcgtgtgcagataatcccaggagatgcctggacgctggagcccacccttgactcccggggggtgggggtgggggcttctactgtcccctcagcgcctgtatggagcattcacacttcgttttgttaaacatataatttttttattttgagcgtgacacttctccactagatagcaaggaaaagtggtaacaattacacattacacaaaagtactgtaccattgcctttatcttgaaggtttcggaagcctctacagttaataagttaaataaagggcttgagtacataaatatttgtctaggaaccctaccgtatctacaacacagtaagaatctacgggaggacaaacttttaccataccacgctgagtgcaattgcgttataacatttcaaatatacaaagctctgttcttttttttttttttttaataacaatggtatgtacagaatcaataatcacagtttggtgacttcaacagtccatattctagcagagtattatttccctttggtttgatataaaaaccttggttggtgtatgataaagaagagaacaagaacaagacgcccctttcctttaagtgcactgttagctatcttacaggctcgcatttgcttcccgggccctggcttcacgctggggccctcgctggggagatcaacttcgagcgccaaaatgctatttaaaaaaaaaaaagaaagaaagaaagaaagaaaagaaaggctaagtggggtgtcaggaggaagaggttgggctttttaaattttttacttcaatatcaggcgtctgggggagaaaacctccccgatattttcaggaaagtaagaacaagagagagtggatgttggagttggagcgaggttggcagtagcaggggcaggggcaggggcgggtggacagccagccgaggaggtgccacgtcccggagcgccgagggctgccatgcccgcatccagactgctgtgaaggcggctgcgctctctcagtgccgtctcgggagtgtgctggtcctctgtttccatttggtcttgagtggtgctgagtgaggtgacctttcggggcgcgcgcggggcgcgggtgtggagggcagcctttagcacacctccttgcccgtgctggtgcccggcaggatgttgagctgcgtgagctgcgccgcgtgctccttggccttgagcctcagcgcggctatgctagaggcgcgtctgtctgcggccgccgtggccgggtcggccagggcgcccgatgccactgcgccctccacggcgggtgtgggctgtctcaggagcgcggccgcggtcgacgcgctggtcaggggggccattgtggaaaagagcctgcagggagagcaaacagcgcggtcatggcctcgggagctgtgcgcggcgcctcgggcagcgtctcccgccgcttgtcgccggggcagctgaggggcgcggtacccacgggacccggatgggccgcggcggggaagtgggcagagggcgcgggcggaagctggaccccgcagagagggctttcctggggcagggaaccgactggggggaaaagaccgagtccagatattccccgaggggccgggccgggccggggtccacaggccggcgtggagacctcaagccccacggcccagtggcgtggattcggtggtttcgcttaaacggacggtttattccaaggccaggggctgcaatgacactatctcccaggagagaatgcggaaggagaaaaggagaggagagcaaaagaagggaaggtggagggtgggaggggggaggaaaaaaaagacggagaaggtgggattccagctgcccggacgcacgccgcaggctctgagatctccctccggctccttggcccgggactttctgcgccctgaagaaacaggcctagctcgccggcctcccgggccacccgcgccgccgcggccgcccttccgcgcgggactcagctacccgcgtctggccagcgcctgcgggtgagagtgaagggcgaccgcctgttgatttcggctccacgggcgggtgtcacctgccagcagccccacatcctggcgcggcgaccccagctgtcttccccgcgcccctgtagcctctggcctcagggagcccccgacccacgaccctggcgcgcggcgcaaggcgatgcccaagcctgggacccacgccagcgccaccgcctccaagcggcgaccgaattactccacgtgacgcttccaccccatgcacacagcaccgggacattagctgtggccggagccgcccggggccaccggacaccacccccacgcccaccgccttggagcgcccgcgagctttcccgaccgcctccctgaggggtctggctccaggcccgcggggccaattccggatttccagggttagaaatgagcccacctgggctcaccgagcgccgcctccttctcccaagcccactgctcactcctcgcaccaccccagcccagaccctcttccagcctctccgaatctcgcaactcggtcctccagccacggttcgcctgggtttacaagtcacttgtcagagggaaaaagtggagggaggggagagacagaactttaagatttttctcagaaagaaatgataaagtgtgacccggaggtggcgtaacatgccctggttccattaggtaaactgagtcactaactctgcttcagtgcgctcgctgtttattttattggtttgttataagaaactaaatttactccgagtcttaattttctgtaagatgattttttgttaagcagctgcgcagttggatgaatctattatttctttgttctcccaaagagtgatcattgaagctgcatccagttttattttcactgcgctaacacaatacatccctcctttgtttctttgtctgtgtgattatacagactttttatttcctcattcgatgttcattaaagaaagggagttataagatgaactgtttcttttatttcgttgtcttgtactgccgtgtagatcggggcttgcacatatgggggtgtcgttggcagcgggtcacttgagtgacaaggaagatggagtctggggcagaagaaagaattctgtgcacccagagggcctggtggctccagggctcccatggggatcagggctgtgttcctcaggctgccaggttggggggcataaggaagaacttttgcaaaacttaaaaagtcgtccctgctctgtaccctacacctgtacatatttgctcgcttaccacctatggtgggacttgttgcagcctgcaaatggtacttttacagctttcattctcggttgtcacggttgtcgttactgccactgccttcccctttcccattaagttccaagtcaataccttcaagacccacatttttttttttgaggctcaattagagagtattttctttggctacagtctctgaggttgggtcaaagaaaaagatgtgtgtaaccctgtttgactcctgcctcctccctgcccccagcctctgtgtgtatgagagacagacagacagacagacttccgaggctgcgcgttacctgccgaatgccgggctgatgaaagctgggtgtcggaacactgccgctccgaggaaagtgctcaggcccagcggcgccccgctgggcggcaggctggccgagcccggaggcggaggtaggctcgggaaggcggcggcggcggcggcggcagcggcagtccaagcggagtcgagcgccgggtggtgcggagggaaggggctggcgtccaggtaggggctgagcgggtgggtggcggagagcggccccgggaagggcagcccaggggggtgggtctgcgcgcctgccttctcccgcttgcgccacttggcccgacggttctggaaccagacctgcaaggcagagagagcccagggtcggcgcggctcggcccggcgggcgcaccgggcccctacccgtcccttcccttggcgcgctgcggggcccccttcctttccaccgcggcccgcgcccacctgcccctctttggcctcaggttgttttcggacgcgtctggggccaaatgagcagtgaataggagccgcaacttcaagtcagcaggaaacaggacaagcaaaccctttctgccggcattccacctgggccagttttccaagtttaaggaaagtgattcagtgtgtttagagttggggaaaccaaagtttaaacgtctgtgctgacgcttgctaggatctttaggcaggtcacttaaacctctctgaacctcagttttcgaatctgtaaaatggggataataaaacttcactcataaggctgttatgagaactgggtaaaataaggcaagtgaaagcatgcattcaatggtgactctagggaatgggcagccaccaagagatgagggacatgcttgttttactgcatatcagctattttcacctatttcagatttacgcaagagctggcaaaattcttgctctgtatggaagaggaaagtggaaagatagttcatttattctttccagaaacatttattgaacaccaaagagcactatgctgggttctggggttcagagagggatgagagggagggaagaaaggctcgagttaattagcaagcatacatttcagggggtcaatcctctatgaaatgaaacagggatacacaacctgctcttggcaggggatccctgcaggacccagttctatgcaggaaggcactgactacatggatgaagcaggcagcaatacctgggcgcatagaaatcagagggcatgataggtgtagacttttcacatcttcagagctaacaagtcttttatttccttttggagatgtgttttaaatcggctatttaaataagatagttttaggcttggagggaggttttcagcctgaggtattttcctaattgctaatagaaagcggttttaatggagacctttacctgaaacatggcagctaccatcatctaaaaataaaccccaggagcatgaaattatttttatgtgacctgctcatcacacccacagctgggaagatatgctccttctcccctgaaggcattaatatttttagggctgggtttataactgcacacaagtctgaaaattaagaatgaactccagggctatacagagttatattaaaatataatgtaaattatcccagaggaatatattttaaaatgtgaaacacatccatatttttcaaatctacacactggggcttgttgttaccagcactagcatctaagcttggtttgacttctagacagccccccagggcaagaaaaatcaagaatccaaatcggtcaattacttccaagtcggccaaaagggggcccattcacaccattccacagccttcaaaataatctatttgtgaatttcagaaacacttcagtgtggaaacccagaggcttgaaaaagtaagactgtagatgggaccggactgggtgggcagcttttgtgtagccaaatctgtctagacaagaatatccgccactccttgatcgcagtgaaagaagaaggggaactgggggcagtggactcagaatgccctcaaagaacgtggaaacctttttacagacagatcgtctctcccggctcaactgcaattatcaagatgtccccctgcaattcctcattattgaattaatacctctgaggccccccaaaggtaaacgaaaggactctaataattcatattcacttaattacatcttctccagtgaatagggggagaggagaaagggagggggcgctctctttctttttaaaagttatttaactttcccacgacttgttcccctgagctgaaaatacggagttgctgtcacatctctgtttgacaatggagaaatgtgtcaacagaaaggaggggacaggcctcatcattagccctctaatgcaagaagctgttgtgtattaaatgagccatatggaatttattgtgctttatcagcgcttgattttgactgtaaagtgattcactcagctcctaactcggggacatctgttttctgttggccatcggggctgctcagtgttgatcgtctctttggttatgaggcctgggttcggaaatgcactctggtatggggctgcaaacacctttaatagcattgcactcactccctattagatcaatgtgggttcattgctataaaaaatgggaaatcaaatagcattagccagctccttgtgcggggcggaggggaaatcaaacagcattttgccttcaaatggccctgtttgttctagcactaagtgggcttttatgaagcccgattggagacttaatcgcagccaaatacctgcttggaactgagcggatttgtctaacaaccaaatccatgctccatcccattatttcaatcaggagaagtagatcggtggattgtttcctataggagctttggggctagggggtcccaaactgcagtctcagggactctaaagcccttgttctgatcctggactccttccttgggctcccaaacccagaaacctcccgcttccacctcccatgtcttaagttttaaatatctttgtgtgtgagagagtgcttgggtctacttttctgatcctgcttctcttggttttgtgaaggggatctcaccccccgcacccccccgccaccaacccatctctctctctcccactggcccccagccctcctccctccctcttccctctgttgtgcagctcacctggactcgggcctcggtcaagtccagcctcatggccagttcctccctataagaaagcaacacacagacaggaggtcactgcaggccccagcaatgccctctcagctatttcctcctctatggcaggcctactccaccagggtctcccctggctgcctgccccccacccccaaacatatgggcattaccattccatcaccccctggagtgccaactatttgactgaaaatgcaaaaacacgaagcacattaccagatataggatattatctattatatcatactacattcgtgtgtgacaaccaagggtggcttcaagtctacaaacctgggtacacaggttctctctcactgtcttaagccagagttagacaacacacacacacatacacacacacacactgcttataccctgttttgtcctaatattaagtgggataggaactcagcacttaactaagaaaatatttttctgtcctcttggtttccttctgccttctttttaaaaatttctcttccctccttcttccttcttctctttccagctctatgcctttccctccatctctctctcccccgccttcctccctccatcatccccttgggtcacactccccattaccctctgcaggtatgttaagcttgttaagagttcagtggggtaatttttcgattaaacaaaattctgcgcacctcctgactccaatgcccactacaaaccctgcccatctcaggggaagtcaatttaactgaaaccctaccccatcattgcagttattactgcgacaattaaggcaaataggaaaccattaagatgctgtaaaacggcttacaacctgtttaccgaaaatatgaccgcgccgagaataattggccctccggctcgctaatatgaaagagcggggccgccgaagcctgggacctggggttgccctgccggtaggcccccagtccacacctgaaacttcagcaccagaggtaaaccgtctccataagtgccctccgttgccgttgcccccagctacagtgggcatcagcaaatctaaagcggcactccaggctggctcagggccggagccaaggggctcaaacccctgggttggaaagaggtgggggtggggcggggaagaggagctgcccctcctcgtgcacttcggtcctcccccgcccctaagcccgccagaagctaagaaagggcggacgtggatgccaactgacaccagctcagtttcttctttggaaatacacacgtacgataaacgcaaaacgctggtcggccaattcgctatttgacagcacacataggttttcaaacttatttccttttttaaagataaggaaaggactgggtgacacaggggaagaccaagtgtagcccaagggatgaccaggtttaagtgcctttgcctggcattaagtctgctcttttctgtttctggttgggagagagttaggcaattgccaggccaactacattttggagtagctcggcctcccgagccctaagcagcgatttctcctctggttcaaaggggcgggcagcattccccttctaaaatgcacattgaaaagctgcgcacgtctccttcgaaggaactgcccgcgcttgacaagccccgcgctaggcagtcaccgatccctttctccccctcactgggggacgtttgccctaagactggctcctcgcctgagctgagaacttggccttggggtgggagagaaggatccctacccgggccggcgccccaggtggtgaataagctggggccgagggtccagtcatcacacaggcacatgtttcccagaaaaacaagtgggaggtggagcgtgaccaggtcgaacacccggcttggacactgatccaaagagaaaattcccccaactgctttgtctactccctgccaggcttccagcaatcattgtccacccggtaaacccgtttacattaaacgcacggtgggtttaatatgtgtgtcgggagaggacagagagtagaaggggagattctggctggggcccctcaggtgttcagacaccaaacactgcccagttctgacttcctttggttatttcaggagtcctgaaacgacagaactcggatctttttaaaggccttctccgctggcacgggctccagcttcactgcgaactgcgtaactgatacccaccaggcccctggggcaccaggcgggggtggcgagcgcacagcacagcgaccaaaaatagcccctgctttgctctgtctgcggacagcgcttcctgagcctcgccggggacctagccgggaccgcagctccggaggccttgtgtctgtgccctctgctgtgcgcgcgtctccaaggtggcgctttcgggcgctctttggagaggctgtttcttttcctctctctaactaaaacttgtaatttgaaaacattaaactgcaacgaccttgggaagaagataaaccattccagcctaaacttaaagcccgaaccggggtgggggtcgggggagtgggtagtttgggtgagcaagggtgggtgtgttgggagggcgctcttccacagagtccaggagccaagcgtccgccccgaggccggggcccctgccagcccgctgtccctccctggggcccgcgtgcgctctctgccgctgcgaccgcgaccaccctacgcgcatacctggtgaagacgtccgggtagtgcgtcttctggaaggcccgctccagttcctccagctggtagctggtgaacgtggtgcggtagcgcctctgtttgcgtttcagcagcccctcctccgagtcgctgcccgcagagaggcacacgctgtcctcgccgtccttgccctcagcgtcttccgggtgcagcagcagctcctccttgggtgacagctccccgccctctgtggccactgcagcggcagctgctgcggccacggcgccagtggcggccacaggacagcgccggggctccttgagcagcgcgcgggcgtcgtcctccagcagctcctcctcgtcgtcctccagcagttcctcttcctcgtcctcatcttcttcgtcctccagcagctcctcctcgtcgtcctcggtgccggtgccaccacccgcagccggggcgctgcccgggccgccggccacgccgaggcgctcctccgggtgcgtgacgccccccgggccgcccagctcgtccagcgcgggcggcggcggcacgaagggcgccccgttctcgcggtacgacttgctgcggctgatgctcacctgcggcgcctggctgatcttgagcgtgtcccaggccgcggcggccgcggccgcggctgccgcggcggcccctgcgccgtccggccgttccccgggccgcgcggttggcggtggcggcggaggggcctccccgcgtggacccgccgtggccgtggcggccgctgccgccgccgccgccgccgccgccgccgccgctgccgcaccctgaaggaggcggcccccgcccgggccgtacaggcgccgcagcttgggcggcaggtgcagctcggcctcgaacggggcgctgctgctcttaggggagcctgcgggcaagggagagctatcagccagccggccggccggggagtcccagccagggctgctgccggggcccgcccgcagttgctcccccagtgcctaggcccaggcgtgcggggaccgcgcaccaccagacttcgacgccttggcctctttctccacttttcttgctttttctttttctttctttctctccttctccctttctctgggttccttcttttttcccctttcctctcccttctttccgttccctctctcactctcccccttttatttcctatcttccttcccttatctattcctcttgcccctctctcccttccttttctctccttaccttttttctttttctttctccccctcccttcttttcctcacctctctttctccttctctccccctttctttctctttttgcaggctttctctcccctctctccttctttcttctttattcctttctctttcccctttcctactctctcatttttatttcccttcccacgtcggggcagaggaaaatccgaaaacattctacaactttaaaagaaaatcaccactatcctgaaaactttgcgcatgacctctgcccgctgctccaccatgagggcaagggttggcaagaggggtgcagccctgaaggcgaccgctgcggggcggggtgggggaaagcggccctgtggccccaagtgcaggccgcgccccaacagcccacagcgggagagggtgggggggcttcttgcacaaaaaggcaaagaaaaatcatcctggcaaaaatgttctgggaaaggtctggggcagagagggagtgggagtgcagcaggcgcaggccgctccttccttttgaggaagcgcctggcataggtgccactgcaggctaaaaaaagaaaagaaaaaagtcagttttatttaaatgcccccttctcaaccgtctgctcctgccatccaaattgcgctatggccggaccgctggtttttggattttaaaagaaaccaacagttctttcctttccctgcgacacctctgcagcaagctcgaggcgaaacttgaggataacaggttcggggtaaaaggacatttgttctggaatttttaatttcagaaaaaaataaaatattttaaacagctcgtctattttaaaaaataaaatagcagagaaaaaattagcatccagaagtcacacatttcatacattttaaatacattaaggagcatttggagaatcccaggaagatgttttctgcaaagcttgggtttaaaaggtcacaagtaatctgcaattaaaaaaataaaaccaaaacattgcatatacagaaatcttccaaagaggaaaggccaaggctcactcagcctggagaccccgattcaccagcttttgggcttcttgtcttcatcaagttggtgctacaagggtccaccggccatctactgtttctgacctgtcgccgctcttcagagcacacccaaggccaccaaaaggggcatttaaacaacctaacgatcaacaccgaaaagctaaaggctccctaagcgaaaacgggcctttttctggaagcagggagggagggagggagagacagccctggctagatgtttaacgctctttgaggcagcaggcctcagagttatgccctctccttccttcctctccaaattgacaattccaggccactggcccccgaacaccaaacatccaaatcagggcccaatgcccttagtaagtgcctgacgggagcatccttaccttgcacggccttttccgggtcggcgcggctggtcagcggagcaggcaagctctgcgcggctcccagcaaccgcattttgcacgggctcctccggcccaggatgctgtcgatgcagtaggaggagagcaaagttggagatttacttttgcactcgggcctctcggagcagccctcctcctggtactgattgctcatggctggggctttttcccagggcgcagagagcggatcgccggctgcctctcccggagggtgggatggatgggtgtgtgttgggggtggggttagatagcgggttataacggatattattgcgatctttgtgcctttctgcctcccttggttgccggctgccggctcccgccctgcccgcggcccgagctcgccctctccgcgctcaggacaagcggtaacaagtgtagtgagcagcgggcgctgagctctggagtctctctcctccacgtgctgagaggcgccctctgattggctctcgccagaggccgggctgcgtcggcctgtgggcgcggcgcaaagcccggactggattccagaggggcaggcgggggtgggggcagcgggcacgcaccagagccaattttccttttctttctttctttttttaagttaccaattttctaagtccgctatcctcttcctgcagctcctcctttgaccctttagtgttggccgaagttctagcttattgggatgccaggcctgtgaatgccatctgggtggcgtgcgccccttccaccaacccgaggacctcgctccctggaggcgaggcctcgaggctcacgttcagactcactcggcacttttcaaagccgatattgggctcccaggacaccgccttgacctccctggcgctcaattgccgtcctctctaggccggacgggcgtcggggggccagggtgaccgccccaagcaaacatctgccgtctgggagttcgcttttctcttgcggcccaaggcattgcgctgtctatcttcaccctgagcccgactgtgtctctcttgtttgtagcgtcccccaaccgctctcctctccgttttaaactctggaatgggaaaaagcctccttacagacaaagctctgccataggcgcgcggccttccctagagcatttactgggtgggaagggacaggcgagtatcagcagcgaggaggggcgactggggacgagtctgggggcctcctctttctccctggactctcttccctctttcccccacaaattcgtatctgttaggccttcaccctgaggctgttcaccttccaatcgcagctagggagcagaaccctcagggatccctgacctctccagggtggaaggaacccaaattcggctgcagccaaatctaagcgtctaaaattctgaattctcatgacctggctcccttgagcaaaggtgagagagtgaaccttagagagagcgcctttcttcccaaacagtttccagcgccgagaactaaaacccaactccaactgatgttgggtcgagcctgggccagcacggacgccttccctgcctgggtgcaggttcccagggatttccaggggccccaacgctggcagaattggggcgaaggtggtgggtgagagaggggccagggagggggaatccacgccgggttttcctctctcaactcccttcaatgtgtcaaagagaaaagcattttacaaaggattatacttgaatcacttacagtcagtatttaaaaatacaaggatgcataactgggatttttttttttcagccataaacatctgcataactcttggatgctggtgggtgggtagcagacagatcgggctgcctccgcaggaaacttcaagacaaaactggggggaggggatgaagggttgggaacaggcacattaataatgcgaatactaatactgatactactactactattaaagacaggacaaaaagaattcctctgtccctctctctctctctctctggcttttagcttaattctcatccgtttttttctgcacttggatgatagggcgggctgtggtggggagcggaggagaacccgagccatcgctgacatttgattttcctttaagccctctctgcgattcaaagtcacctgggatctctccttgcctttcccgcattcttccttttccatccccaccaagagttcggtgtttttacaccgtccggttcagctttaaactaacattctgcgcgctgatttcctcccacattccctcccccggccccgaaagcccattccaggcgcgcgggtctcatcgcagccaagaggagtaaagacacttcggtttcctcctagcctccagccgcggaccctcgcgggcgtccctgcggcttggtggttgggagagacggaggcacttttccctccccggcgggccccgcgttggaaatccacaagacccggctgccgggtggctcagtgacttcagagtcggctccgcacacgcagggagtgggctgaaaatgagtccaagaaagatcgtgttaaacaaaaacacaaatgcacaaatcatttctgagagcccaacggagtttcagctctctgggtggaagacttctttgcctccatcccccctcctcccccttgtgcagctgttcttcttttaaaagaagtcggactttctgctggggtgtattctaattttaatcatccactgtaaaaggggaggttaacaaagaatttctgattctgacttaatgatccctggaattagatctaattctattaatggaatataaagtgttttcgggggagacctgtgtgaaaacactagttttatttgttctgttattttatttatttttgttattttctaatcaatcttcccaagtgaggatgctattgggaaacacgtccattcacctcggggagaagggcctgacctagctcactctacacccagtggccctgagaccacctttgtcacaatccaatacccaacttcaaaaatctacaattaacttttgctatttctaagagattaaatttaaaaaattacagaaaacttttctaaggtgctgggtagagagacataagactgtgctgtggtctccacaatgcctaatcaggatatgggattatatatatatatatatatatataaaatatgttattctatatatcattttagaaacaaaattatgcgtctaatatctaggaagagggtaactgatgtgttgagtgggcagacttttaagaattgggctataggattacgtatgaaagaacttacagtttagcccaatttaattttactttgccaggaaaacgacacttcactttctttttgcctcacttttactcactaatcaaaagtaattgcattttagtgataatatcattcttgtttgtactttgttattcacaagtcctggctcctctaatctttggggtctgtagctgttggtttgcttttcctggtctgcttggaaaacaatggtttgcagtttatctgcttttaaaatcaatcactaaataaaaatgacaataatggctggaagtgaaggtcacatgtgtttagaactgttgtttatggtgaaaaatggggcttgttcctagaactggaaataataatttacctagaagaggagagtggaaggagaaacccctttcttttctgagagctaattctacattatagttttaaaattacatttgcaagaaatgtggaataagggggggtggcagttagatgtcattatccagaaaaaaaaaatgtttggaagagagttaacctcacatacttttcatttgagatgttttaatttattgtgcaatatacacatagataaatcaagctgtgatgggcttccagttgcaccggacggctcaggtccccttaaattacgatcagcctcttcaaaacatatatttaaacaatagaaataaacttcattggaatctagcgaccaatttggaagccactggaagagaagacaataagacctgattacacgcaaggattctctgtgatgtgatatcccttttgccaagtcattttgctgttttatttatttaatttcttttttttttttaaacaaactttcattcatttatggtcttccgcaacctgctaatttaacactggagcgcgttattgcagtgttaggaggagagaaagagagagagaaaacaacaatactgcaatgatccaaatgatacagtagaattatagcaattatagttctacttgtggaagaaaaccttgctgagatcaggcaaacaaactgaagccttgtgaggataacaagcgtcgggattgacagccggtgctgggaagagccggagggcacaaacagaaatatttgcttccccccacccccccttaactccaaccagtcaaggttaacctcctcaaacgctgctttcagagtcttatccacttcagggtatgcattttatgcacaaatcgaggtgtctcctcctggaagtctggtaataggaggaagtgtaacataatccgcttgcctagaacttgcccctcgccttcttggcctcctgcgtgctctccacttcctaccctgcctcagttctccccacggctgttgggatctctctgtggacggtgtttatttgttgatgtattttcaaagaaacagcccgtggaaaggtccaaagggactgatagaacttggatttcctgggaagactctgtcgcgtttgctaatccttccctcttcgccgtgtcctcctcctaagccgtgggttccacagttagggcttggctgggagaggtttgttgggaagcagcttttttggaagcctcccgaggaccacggccgagccctcaaggtatggacgcgtgagtgtgatggctatgttaggacaactccccttatttgcaaacttcctcactttctgttgcccgtcagcagccgggggagggggtgggggagcaagaactagagaggaaagagaccccctcaccgccaccaccatcagccatccgggcggcagccgaggctttttcaagctttgctccaagcataaagctggacgagatggtcgcagcctcctgtctgctctcagaagagggggtgtgtgtcccctcccacgggcgagaagcaggtggttgggctctgagctctcacggagttccttggcgggagttccccatctcctgccgcacccatccctccaggtttccagacctgagagagagggaaactttactgtgccctgtaatcaccaccatctgctttctcctctcctccgccggacggcgggaccccgcctgcggccagggtcgaggcgtccccggtgcagcgttgactcagtagctgctgctccgggcgaccctggacggggtggagggtggggacgggtgggcacagattggagctagagtaagatgcagcgggctacccaacgcgtgtgtcaattcccaggccgcgcggaccggagctgggctgtcggcgtccgcacccccagcctccccacctcagcccccttttcgggctcggctcagcgccacggccagagcgcgccccctagcgggggctccgagtgggccgggctctcctgccgcaacctctggggactgaagttggcagagcccagtgatccggcaggaatgaatgggggaaaaaaacaaaagccttggaaacatttccaagtgttcaataaaagacccatctgtacctttcttctccagcgcgttcgtggttaatgtccccccatgcgcgcgagaagggagataattgctgggtggattcttgtcggcgaacctcgggaaacgctggactgagaagtgaaataattgggggtggggccaaggcaagcgtgccgaggatgcgacaccagtcaggaagtctgaatctgcagtctctggggtgttcatggaggcctggcggcctgagcccttagattcctcagtgcctggtgttggtggtggtggtggaggatcgtccgaaggcagctactctgagatttctctgatttgacatcggcctctgtggtaccttcatatcactcatggtcccctcctatcttctgatttgagaataccccactctgtgattctaagttccctgagctcagattttggggctcccatcttctgaagctaggagtgtccactttttgactagatgatcccctacctcccgtctctgggatttctccatcttctgacttgatggacttctgggccaccaccctgctccatctccccccaggcatcctcctctcccactcctttcacttctcctgcaacatttgcctctggaaatcctcaaatcccagcttccactacttccactactcatacattacctactccctcttggtctggccagaaattgagaaaagagaaatgcagggttcttgtccaaccctctttgacttgttcaacctgga

SEQ ID NO: 9819 - DNA, 1913 bp, artificial
  synthetic oligonucleotide
cttatcaattaaatgacaggaaaaaaaaaatccaccccagagaggagacctagtatttattggacacatgggaaaaatgagcctttctaacagagggatggtcatcttgtacaagtacactgagggcagctgttctcaaccaggatgattttgcctccccacccgagggaacatttgacaatgtctggagacatttcattgtcacaagttggggagaagcaggagggaggctgctgctggcgtctagtgggtagaggccaaggctgctactaaacttctacagtggacacaagatagacccacaaataatgattggcaccaaatgttagtaggttaagatagcaaagacttggaatcaacccaaatgcccatcaataatagactggataaagaaaatgtgacacatatacaccatggaataccatgcagccataaaaaaagaatgagttcatgtactttgcagggacatggatgaagctggaaaccatcatcctcagcaaactaacacaggaacagaaaaccaaacactgcatgttctcactcataagtgggagttgaacagtgagaacacatggtcacaggaatgggaacatcacacaccggggcatgttggggggtggggggcaaggggagagagagcattaggacaagtatctactgcatgcagggcttaaaacctagatgatgggttgataggtgcagcaaaccaccatggcacatgtgtacctatgtaacaaacctgcacgttctgcacatgtatcccagaacttaaaaaagaaaacaaagaaaccctaatatagggctagtgagatggctgtgtgagcgtgagctggtgaggaagggcttggggccactgtgccagtgctgacggaatcctcgatagtattttgtcaagtcgaaggacagtaataatgataaatgtagcaatggttttctagacacgaggaaaatggccttggtctttgggtggctactttgtttgtttgtttgagatgaagtctcgctctgtcacccaggctggagtgcagtgacatgatctcggctcactgcaacttctgcctcccaggttcaagcaattcttctgcctcagcctcccaagtagctggaactacaggtgtgcgccaccacgcctggctaatttttgtgtttttagtagagatgggttttcaccatattggccaggctggtcttgaactcctgacctcgtgatccatccgccttggcctcccaaagtgctgggattacaggcgtgggccaccgcacccggcccttgggtggctactttcatagaaaggcagctatgctatattgatatggaacagaggcttatttattaaataaattcactttagcaataataaactcattacatgttaacatagaaaccttttatgaaaatagctatatctttcaaaacaaaaaaaaaaaatggtgagaagagcagcattgttttaaattttggcaaatctctttattctctggcttaatagaaagccagcctgatttctcatctgcttctgcattcaatctgtggtaacatcacacatcatgtagcctctggaaactccactgtagacccatgagagaatgagagtggaaaaagccagtaatgtcttcgtatgatttcgaaaaaagttttgaccttgaagacccctaaaagggtcactccagatgtcccctggcccacacattgtaaactgctgctctagaactgtgagatctgtgaagcagaatggggaaaaagtcacatgtttaatttcactactctttaactagaatttagcgcacccttcaaatatggatggaggcctcagaatacagtggtattagcagtatctgactttgttatcagcagtagacgtcaaggatgttttctgatcacattacagttgttgcagatatctaaaatatca

SEQ ID NO: 9820 - DNA, 1260 bp, artificial
  synthetic oligonucleotide
atcttaaaacagacgtctttaactataaagaaaaggagtgtggtaagacaaaacaaaatagaaattggaattaaatgggatgactgacagaccaaactagttttatttagacaataaaaattaaagtcctgttagcattatgacgaaaaaaatgtaaaaatgttttacttaaagcatggctgattttttgttgtgttttgttttttcactaacaccatggtgaaagtttaaacatgtaagacctgtttatgaagtaaatgtttactgctgaactaattcttcaagtttactggtatattatatattgccttaccaaaaaaagtcgatgctgaaaagtcagtaaaatccacagtaaaagaaagcgtctgaacagtagtctgtcttgggaaattattcaacagagtgcactctggtctctgttagtgaaggctttatcacttttaacaaataagccgcagtaaatttatcagtatgctacaaagaaattttcaaaataattaagactaaactacacttgtcaaaataaatgaatgaaatacaattttgaatcatctttcttcacttattgctcatttgcataattcagtaacttacacaggagtctttcagtcattggtgtgaattagcaaggttctgctattccttgttgtacggcaggaattaccctaccatgtaattagctattccagacatggactaacgggaaataccaaagggcacagcaaaatctaaagaggcaaggcagggaatctaaagacaagagacaatcaaagacacccaacaaactcaagctggtagaccacagggaattttgaatgaagcctcttaatttattttgagaataagaaatcagtagtatgagagaaatctcaacaagattagctgactaagcctacttaaaaaaaatatctctatagtgcatggtgcgccaggttaaccactcctgtttgttagtctgtatacagctcaacaaataagcggcaaagcttttcatgggtatatagtggctttccattgaggttttcactctttgaaggaggtcatttataccaatgagatctgtagatgcaaattgctttccctatatgtgaggggtcattcctttcacagccagcttgctcatctcttttataaaggttttgttatttttgtactgctcccaaaggaatgatgagaattatgcccccccaccccctgtctaacttagcatccaaatcttttccctccagctctgtgaaacttttgtgtgttgatctttgg

SEQ ID NO: 9821 - DNA, 975 bp, artificial
  synthetic oligonucleotide
taagccaccatgattttgcttccaccttcacagatgaaaaacaggctatcagatagagaggccttcaactttcagtacccttcctcttataacttgttcttgcccaaaccatccttgccagcttccttgccactacagtgggagaggtgtctttttttctccctgaagccaatccttccacttgtgcactggagcccaacctgtccagcctaagagacattcccttcatcagttgtccccatcaccatcgccccttccctctcccactggctctttcccatttatatttaggcacaagttgctatcatcttaaaagaatgagccaaccaaaagatctgacatcttggatggatgaaaggaatgagaaataaaaggaaaaaaagatgaagggagggaagatgaaaggaacgaaagaaggaaggggaaaagctagtctctagtaaccctaagccctgatttgtccacctctgggtactgtacattctatctgcttcctctctcagtcaagcttccacttccctaccacctataggctcctcaatctactgccatccagcctccgctcccaccacttcactgaaacatcaccactgacctcttctttctaaatccaaaggaaacttttcctccttaactcatttgatctctctactgcatttgattctattggacattccctccatgaaacttaccctgcccttggtcccttgatctcccagttatttgagaaatacttctctgtcttcttttcatgatccttcttctattggccctttaagtagtctttcttagggttccaacctgggaagattctgggataaagtagattagcttaaccagatttcatgtagagacagatgaatagaaggaggagtctaatagctttaattacagctcctctattttccccctctaagaacctgataggatggctcagggtcagttactttctagaattagccctgtagtgggatt

SEQ ID NO: 9822 - DNA, 1914 bp, artificial
  synthetic oligonucleotide
tatatccactgagtctcagagaaatactgtactgttagacataaaaatagggcatcatcactgaaaccttttggtttgttttttactgatgcttcagaaataacaaaagctcttcagtgtctatagtatgccaggtactagatgagatactctgctgttatctcttttaggcttcgcagcaccccgtgatgaatagatacttctatccttctagagcataggataatactatccctatttcacaaaaaggaaactgaggctcattagagttaagaaatacgccaagtcatgcccttggaaagtcacaatgcccagcttcgaacatttcacaaccgagggcagtcttcaaacatttagactcacccacacccaggagacttggctggaaagagtgccatactcagaagcgtggcacgccatctcctatatttcacacacaccagcttggccaatgacaaactctgatgtctctttcaatgcaaaggccaaagctgttatctgtgccttgggaaggcttaaaagcacagcaatttgggcaggctgcagatgacttctcctgtggtagcttcaacagcgactagcggctagaggccctgccccaggcagcttgggctggggctctggggaacgctgtgagaaagatgtagtcacttggaagcctgcccagaaagtggccctgcattttttagtcagcctcttaaaatgaaaacctcactctctccagacaaagcaagcggtgtttttgtaaacaaggcaaatgcaatccagagttgtccatttgtagtctttgaactgtgccgtgattgcagtcaccactacatcatctttgtgatttttaaagctaaagtggatcagtcatggtaaacattattcactgtgctgtatcaattgtttcttagagatggagacaggttaagatgtgttccttaacctggggacactagactgaagaatgatccatacatttggacaggggctatgactcacttctgccatttatttatccattcactcactcattcaaataagtggcaggcactatcttggaatctggggatagaagtagggataagaccaataatccctgcccttggggagcccccattctctgcactgacgagaaccgatccctcccctgtccccatcccctctccccattgcagtcccttccaccctagaagctcaatgttgtctggaggcctcccagttatctgagattttcttagccctcaccttctcctccagggctctggaagcaaaccaagacttgggacaaggattcaggaaacttgggttcactattcgttctttttcagatacattatggcgacctcataggctgtggtagaccacagtggcatttgtaatgtagcaaaggggtgcagtgacaagaacaaaaactctgtatccacaaaccccgggttcagatcccctctccagcacttactagccatgtactttaatttggctcttctggttgaaaggaactgacactcactaacagacactcactaacattagctcaaaggatggaggatttcttttaagactaccctggaactgaaactgtggaaaagcaggaaaggggcagaatgtggccccagagaaggtgctctgcaccaacttggctgctctctgcacatgatcctttctgtcccacccccactgactccatttccttccactgcattaaagccgctgcttgctttccactgccccacagcttcagctctaataggccggcccatcatggcctcctcagcctctcttcacaacactcatttaacaactttccattgtgcctttcagccctagactcctaccaacttattgactctttccatgtttcccaattcaaattcctaagggagaatctgattggccaagttcatcttttcaaatcaggccttaacc

SEQ ID NO: 9823 - DNA, 2089 bp, artificial
  synthetic oligonucleotide
agacaaagcaagtcacaaaattattctttttaactggttggaggaaggaagttgcagctctgttatatccccatcatgatactctggaagatgcctcctacatttatatagaaaattctatgtattttgccaaccttgacacctttctagactctcaacaaaggaactagaatgtgaaaatccaagaagattcaaaaatggatgacaggagaaagaagtagtttctcatatcaaagtgctctcattctaagcacccttgtcacctcatctccacggctacaaacaacatagagacattttattcttgcagtgagaaggaaagagacatatgtggccacaatagtgttttttgttttgttttctttttttttttctttttgagacagagtcttgctctgtcgcccaggctggagtgcagtggcgcaatctcggctcactgcaacctccacctcccgggttcaagcaattctcctgcctcagcctcccaagtagctgggattacaggcactcagcaccacatccagctaatttttgtatttttagtagagacagggtttcaccatggtggccaggctggtcttaaactcctgaccttgtgatctgcccacctcagcctctcaaagtgctgggattacaggcgtgagctaataatgttctttaaaaggaaatacaaagaccatcagttaaatatggtgaactgaacatacacattatctctactttctcccagaaacaccacaacaattactaagagttaaaagttacagagttaagagttaaaagttaaagttaaaagttaagttaaaaagatataatcctcccaagggcagagaaaacaagaaaggcaatgacaatggatgagagatgtcaacaacattatggaaagttgactgtcaagtgttgagtgcctacagggaataagaatcaggggtgaagaaggtggagaaagggaccgctagttttctttataagctgggagtactactgacttttaaaaatagtcgggcgtggtggctcaagcctgtaatccatgcactttgggaggctgaggcaggggtggatcacttgaggtcaggagctccagaccagcctggccaacatggtgaaaccctgtttctactaaaaatacaaaaattagccagatatggtggtaggcgcctgcaatactagctactcgggaggctgaggcagtagaatcacttgaactcaggaggcagaggctgcaatgagctgattgcgccactgcactccagcctgggtggcagagatagaccgtgtctcaaattatatatatatatatatgcatgtattacattgatgttataaaaataaatttaaaaaagaaatcaatgccaacttctgttaaatgatctttaagacttagatttaaaattgtgattatttcttgatgcaatgcaacctcattaatttggaacataaagaaatgttacattaatagattcagatgatacaatgtttctaataaattaaatttctctaataaaaaaagttgagagactttatgtcagatagggaattgcaattatttccaattatacacaaatttgaacaaacagaattgccttcataggattatactgtattctaaataaggcacagtaaatagaaaatgctttgaaataacaaactgtctaatgagggagccttgctttcaatgttcttattcaatgtgaattcaattgaggaaaatttgttttaagatataaaccccaggggaaagcagatggcagttttgtaaaactttttgttattgattcagaggtgatcaagagaaatgaattcaggaagcagggaggaaagaaaagtaaagaaagaagacgtaattactgagaaaaaggccatttagtaaatctgaagagtatttacaaagttgattttgcaataagctcacttttaaaaattgtggtgtgtcagcaatttccagactgtgggaaattctccaggactcccctccctgccaaaaaaggaccctgatctttcatctcttcaacaaataaacttcaaggcaaaaaagagagagagagaaagaaaaagagaaatgaaagggggatctgcagattgaaagaga

SEQ ID NO: 9824 - DNA, 3343 bp, artificial
  synthetic oligonucleotide
gaataaaggtgtcccactcactgttccaggaattcttgcagtgtagaggtattcacaacagcaagcagggatttggcctgccatcaattttatttaaaaagcaattaagtttgcagtttgtcctcataaacgttgtaggttgaaactgaaaaataagttaaaatgatcaatcaagataaaaggtgatctatccatccaatggaatattatttggccttaaaaaggaaggacattctgatatgtgctgcaacatgggtgaatcttgaagtcattatgctaagtgaaataaaccagacataaaaggacaaatactatgattccacttatgtgaagtacctagagtagtcaaatgcagagacacaaagtggaagggaggttgccaggggctagcgacgaagatggaatggggaggcattgtttcatgggtacaaagtttcaggtggaaagatgaaaaacttctggagatggatggtggtgatgcttgcacaacagcgtgaatgtactcaatgccactgaactgtacatgtagcaatggttaagatggtaagttctgggctgggtgtggtggctcacgcctgtaatcccaacactttgggaggctgaggctggatgatctcttgaagccaggagttcaagaccagcctaggcaacatagtgagacctctgtctcagcaaaaaatttaaaaaggtaaaattagccgtgtgtggtggtgtgggtctgtagtcctagctactcaggaagctgaggcgggaggatcacttgagcccaggacttccaggctgtagtgagctatgattcgcaccactgcacaccagcctgggggacagaataagaccgtgtctcaaataagaaaaaggtggtaagttctatgttatgtatagcttatcacaataaaaaatgttaacattataaaggaaaagttatcaatcacagaacaagtttcactgttttatggtaataaggaaaataatctgtagttttcttctgactatgtacccttaagcttcaactctactagcaacagtggggttctgcttcatttaacttaaaataatcctgtattaacaaaaaagcagtatatgtgcattataaaaaataagaaaacattggctgggcgcagtggctcacgccagtaaccccagcactttgagaggccgaggtgggtggatcacttgaagtcaggagttggagaccagccaggccaatatggtgaaactctgtctctactaaaaatacaaaaattagccgggtgtggtggcacacgcctgtaattccagctacttgagaggctgaagcaggagaattgcttgaacccaggagacagaggttgcagtgagccaagatagtaccactgcactccagcctgggcgatagagctagactccatctcaaaaaaaaaaaaaaaaaagaagaagaagaagaagaagaaagaaaacataagtaagccaaaaaagaaggagaaacctctgtgttcccaaaacccagagattgccactgctatagcttcgtgtatattcttccagatattttgccatttgtgtatatatgtattttttttgcaaatgagattacactattcatactattttacaacctgcttttgtttcatttaaccatcccatctttccatgtcaatgatcattcactgcaacctctgcctcctggcttcaagtgattctcattcctcagccacctgagtagctgggattacaggcgtgggccaccatgcctggctaatttttatatttttagtagagacagggttttgccatgttgtccatgctggtcaaaaaaaaaaaaaagaaagaaaagaaggaaggaaaggaaggaaaagaaggaaggaaaggaaggaaaagaaggaaaggaagaaaggaaggaaggaaagggagggggaaggggaagggaggggaggggagggaagggaaggaaaggaaaggaaagagctaatggagcattttttgctagaatatccataaacactgttgcagaattacactgagacccatgacatctcattgacccaccattagtgatgttatgattgagcatagtttaggtgatggctgtctgatccctctgagttatagttatttttccctttttcactagaaaataatctgtgtggtgttattttggcactatgcaaatgtatacttacccatcagctgttcacctaatggtttttaccccaattgatcatttcggcctgtgttaaaattaacacagtaattttatttgggtttataaaagaatgttttttttttaaatcattcctttgtcaattattctcctataaagtaaagctcttcctcatcaaataaggccatttaggtattttgaagtacagttcctctggtaactgtttaactccttccttttaaatttaaagggacaattaaattcccttcaagttaccaattttccaggtaagaaatatgttaaaagccaccttaaatggttaacaaatgagtttatggctttgtcttttttagtgttatagtagattttgttactttgatatgttttaattggcacttattttattgaagcataacatatagtaatagtaaagtgcacacatcttaagtttacagcttttttttttacatctatatttcctctacccacaaagactcctttctagtcaaacagttgtccctccctcctccaccatataattgcttttctaactctatcaccataggttctcttcttgaatttacaaggaacacatagtctatactctttttgtgtctggctttatgtgagattcatccatgttattgcatgtaacagtcattttcctttttgatgcttgaattgacatacctttggccaatgagagctatttccagctggatccttagtgttctattgccaaaactcattaatctttgaaagcttttcttgcccaagatgatatcctagattcatcttataccttctgtgcctgtgtcctagaatcaactgtttccctcaaggagtcttgtttcttttcttttcttttttttttttttttttgagacagagtctcactctgtcacccaggttggagtgcagtggcgcaatctcagctcactgcagctctacctcctgggttcaagcgattctcatgtctcagcctcccaagtagctgggactacaggcatgagccaccacgcctggctattttttttttttttttttttttgtatttttagtagagttggggtttcgccatgttggccaggctggtctcgaactcctgacctcaggtgatctgcctgccttggcctcccaaagtgctgggattacaggcataagccactgcacccagccctgtttctttttaatcagtattag

SEQ ID NO: 9825 - DNA, 3237 bp, artificial
  synthetic oligonucleotide
cttacatatttctttctttcttttttttttttttttttttttttttgtgagacggagtttttgctcatgttgcccaggctggagtgcaatggtgcgatctgggctcaccgcaacctccgcctcccaggttcaagtgattctcctgcctcagcctcccaagtagctgggattacaggcatgcgcctacatgcccagctaattttgtatttttagtagagatggggtttctccatgttggtcaggctggtcttgaactctcgacctcaggtgatctgcccacctcagcctcccaaagtgctaggattacaggcatgagccacagcccctggcctggctcacatatttatattggacagtgtggcttcagataatatatgttaattccttattgggagcaatgaaaacatcacattttaatgttcagaataaacatttattggctgggtgcagtggctcacgcctgtaatcccagcactttgggaggccgaggtgggtggatcacgaggtcaagagattgagaccatcctggccaacgtggtgaaaccccgtctctactaaaaatacaaaaattagccaggcatggtggtgggcgcctatagtcccaggtactcgggaggctgaggcaggagaattacttgaacctgggaggtggaggttgcagtgggccaagattgcgccactgcactccagcctggctagagtgagactccgtctcaaaaaacaaaacaaacaaacaaacaaaaacaaaaaaaccaaccacacatttgttgaatttatttatttatttatttacttatttgagacagagtctcactctgtcacctaggccagagtgcaacggcttggtcttggctcactgcaacctctgcctcccgggttcaggtgattctcctgcctcagcctcccgagtagctgggattacaggtgtctgccaccacgcctggcttatttttgtatttttagtagagacggggttttgccctattgcccaggctggtctcgaactcctgaccttaggtgatctacccgcctctgcctcccaaagtgctgggattacaggcatgagtcaccgtgcctggcctgaatttatttcctgaaatataactttcacatgtcttgttccatatttttttctataaacctctctggatttttggatcaatgtattgtttttgactggcagttaatgttatggtggctccttgttatatttgcacaaatttgagttctctttcccttaagcagttgtgataaattaaaaattctcttaattatataagaaaaggagaacttggactattatggcataaagatagaaccttctgaatgttgaatgagttggtaggaaatgattcacattttcttttggacttgcttttcatctttcagtctcgccctgtcggcttctggttcccatattaaccacttttctcccctccctgcagactgacgtcccatttgtttgattttccagttacttttgcacagccacacttgcattaaagagattttgctcctgcctccttttcttagattttatcctcaattgtctctttccaaagggcaggcgctcacctcttttttgtaacctcttacagcttcctcagctcagcttgctctgcacagagcaggtgctccataaatggcaattactgatggcatgcctgactccatatcgaggttattaaacattatgccactttcatttagtcagttatataagtttattttatttatttatttatttatttatttatttatttatttatttattttgagacggagtctcactctgtcgcccaggctagagtgcagtggcaccatctcggctcactgcaacctccgcctcccaggttcaagcagttctcgtgcctcagcctcccgagtacctgggactacaggcatgcgccaccacgcccggctaatttttgtatttttagcagagacggggtttcaccgtcttggccaggctggtctcgaactcctgacttcaggtgatccacccgcctctgcctcccaaagtgttgggattacagacgtgagccactgtgcccagccaagtttaaacttccatagtgtccccatgtgtaaatatagcatctctcaaaaccaccagaaagcagattgctgatagccctgccgtcttttcacaaaactaaatattttgatttctgtcataatcacaccggctctgtgaacctcagagcctttagctcttagaaggtagcggccagtttccgcattcttactattcttaaagtttaagggcccagccatcttcttttcctttagaacatattttaagatactttggagatactttggttccaaatgactccctttcgcaaagtcttggctttttaagtcattttgctccttgaagcctgatcaccactggggacaacagtgattgcgttcttggagaaaatggaaaggtttttaaaaaaattatgttaggaaaagggaaaaacaatctcattctgcttccgagtgtgtttattttgtacctttacatatgtaaatgacagattttttttttttttccctgtaagcagtagtttttctgctacaaggtgtcaccaagaattagaccaacctgtttggagaaagggatcaactattcagaattaaaggggaagagaaaaatttagttgagggtaaagatatctaacttggcttattgcatcttgaccagtttttaaatttaaagaaagaattggtccaggcactgtggctaatgcctgtaatcccagcattttgagaggctgaggcaggaggatcgcttgagtccaggagtttgagaccagctcgggcaacacagtgagacccctgtctctacaaaaaaataaaaaaattatccaggcatagtggtgcacccctgtggtcccggctacatgggaagctgagatgggaggatcgcttgagcctgggaagttgaggctgcagtgagctgggatcgcgtcactgcactccagcctggacaatagagcaagaccatgtctcaaaaaaagaaggagggagggaagtagaaagggaaggaaagaagggaggaaaggtagaagacggaaggaggaaaggaaggaaagaagggaggaagtgagggctttttgggcctttaagatctgataaggctgcattttaacatggcgtggtttatctggctctggggcagctctcaggcaccaaagtcatggctttggcctcactgtctttgtagcacttatgttttgtgtgctt

SEQ ID NO: 9826 - DNA, 2702 bp, artificial
  synthetic oligonucleotide
aaaagtgtcccaatgatggttatcgagatgcaattttttatgtctacacaattacatttctaacttcgccatattccacactcgactgccgtggaaaagatgatcgatgtaaacccagtcctcacaagaataatacataagccaccaggatcgaaactcatttttattttacaaattaggcaaactttctttcagttccattttcttccgttaatataacacattagtatttaagcccagggcagctagaaacagaagaaatgacctgctgatttgggggctgacaggggccaggaaagggtcacctcagaaagaagtattccttcctttttttcttttttgtattttctggtagagatggagtttcaccatgttgcccaggctggtctcgaactcctgggctcaggtgatcctcccacctcagtctctcaaagtgctgggattacagtcatgagccactgtacctggccagaagtattccttcttgaaaagtggaggtgaagggaagggagacagacccaaagaaacagtctttcgggcaaggcacatagaggtttgaaataaaggtgctggcagggccaaaagctccagagaagattctttctttgcttctttctagcttctggtggttgccagcaattcttggcattcctcagcattcagttccatcactccaatgtcttcctacatcttcacatggtcagcatccctctgtatgtgtctgtgtctcctcttcttgtaaaataccagtcatattggatttaatgccacccctccccaacccagtatcacctcattttaactgatttcatctgcaaaaactatttccaaataaggtctgagattctgggttgatatggtttggctctgtccccacccaaatctcatcctgaattgtacttcccataatccctatgtcatgggagggaccaggtggagataattgaatcatgcaggggttgggggttcccccatcctgttctcatgatagtgagttctcatgaagtctgatggttttataacaggcttcccctttcactgggcactcattttccttcctgccaccatgtgaagaaggacatgtttgattcaccttctgccatgattgtaaaaaaaaaaaaaaaaattcaccatcttaaccatttttaagtgtacagttcagtgccattaaatacattaattttcctgagccctccccagccatgctaaattgtgagtgaattaaacctctttcctttataaattacccagtctcgggtatgtctttatcagcagtgtgagaacagactaatacatgggtggacatgacattttgggggacactatcttttagacctcagttgggactttccatttctctttggtagattttatcaatttcttttgatctttcacccagttcagtgaggttcttattacttttcacagttcttcctgtaggatcttagctttacagatttcatatgcatgccttctatgtttttatccacactgttgataaaatattaattaagaaaagtgttgaataggtgagggtcaacctggggcataccacttttgatctcacttctggtacagaaatagttttttaatcaactaagcaatcacttatatctactattatccaattacatgtctccctcctgtccaaaaggatgtcaaacacctggttgaaaccaagacacacgaaatatacagcatcttcttaatggatcggtctagaaattgctgtctcctaagccacaatgagatgccacttctcacctactaggatttataaggaaaaaaaaaaagaaaataacaagtgttaaggatgtggaaaaattggaaccctcatgcattgttggtgggattgtaaaatggtgcagccactatgggaaacagttcggcagttcctcaaaagattaaacacagaactatcatatgacccagcaattctgctcctacgtattttcagttcaaaagaattgaaagcagggactcaaacagctatttgtaccccaatgttcatagcagcattattcacaatagccaaaaggtggacacaaccttttgttgtgtctatccaccgatgaatgggcaaataaaatgtagcatatcctagaatatcattcagccttaaaaaggaaggtaaatctcatacacgctacaacatggatgaacctggaaaatgttctgcttagtgaaataagccagacacagtagaacaaatatggcatgattccacttatatgaggtgcccaggatagacaaattcatagagacagaaagtagaatagagtttaccaggggcttggaggagttattgtttaatggatacagagtttttgttggagatgatggaaaagttgtgagtatagatagtggtgatggtaacacaacattgtgaatgcatttaatgccactgaatcgtacaagtggttaaaatgataaatattactttatattttgccacaatacaaacaagcagaaaaaaattgcccccctcaaaagagatgcttcccccgcaaaaaagaaagttagttgttgtaacttcaaacgtgtaccttgggaccctagagttggcagaaaagttagagcagagcaaagcaaagctttagctttgcatcaaggtattattttaaagcaatttcttgggaaataatttgatgaaggcttcatttttatgtttttgaagtaaagcagtttttctttgttcagaa

SEQ ID NO: 9827 - DNA, 4908 bp, artificial
  synthetic oligonucleotide
cttgttcaaaatcagggaaaaatgttgttaaaaggctgggcgatggccgggcgcggtggctcatgtctgtaatcccagcactttgggagaccgaggcgggcggatcacttgaagtcagtcgagaccagcctggctaacatggtgaaaccccgtgtctactaaaaatacaaaaattagtcaagcatgctgacgcgcatctgtaatcccagttactcgggaggctgaggcaggagaatcacttgaacccgggaggcggaggttgcagtgagccgagatcgcgccactgcactccggcctgggagacagagcaagactgtgtctcaaaagataaaaaaaaaaaaaaaaaaaggctgggcacggtggctcccgcctgcgctttgggaagccaaggcgggtagatcacttgagtccaggagttcgagaccagcctggccaacatggtgaaaccccgtctctactaaaaatacaaaaattagccgggcgtggtggcgagcgcctataatcccagctacttagtaggctgaggcccaagaatcgcttgaggccgggaggtggaggttccaatgagcggggatcggatcgcaccactccactccagcctgggcgacagaacaagactcttgtcttaaaaaaaaaaaaaaagtcgttaaaggtaataaaatgtaaagctctttcaaaactttcttctgtatctctcaactgtttcgcggttttttttttttttgagacggagttttgctctcgtcgcccaggctggagtgcagtgccgccatcttggattaccgcaacttctgcctaccgggttcaagcgattctcccgcctcagcctcccgagtagctgggaatagagtagctgggattacaggcgcccgccaccacgccaggctaactttgtgtttttagtagagacggggtttctccacgttggttaggctggtctcaaactcccgaccctcaggtgatccgcccgcctcggcctcccaaagtgctgggattacaggcctgagccaccgctcccggctctcagtgttttttaaatttgatgtttaatgtcgttctgagtaaaggaaaattaaaaatttaaattagcatgaattttaccattcacccttatactgtacaatcccagttttacatgcagattattaaaccaagtgtggggcccttctgaacatccatgaagccaagcctgccctgatcaaggttaggtttctgagataacccgactcgaggtagagagaaggtcaaaccttgaaatccccaataaagcaatgatttgtcaaaattttatcaagattagtgataaatccaatctataaaaccagccactttgaagtaggctcttccttttactatgtaaatcctgcccaacttctattattttgcctttttacaaaacacaaaagcatactctgaaagacaactggtattggactagaggattataaatttaataaaacatctaactactcaaaaccatttgttagctaaaaataacaatatacccaaaaatgcttctcttttcactttttgtggaccatttaagccaaaccatactatatttttgatatgccaagtaaaaatgatcaatactaatctgttacacatataaatcctggcaaaataaattcaattttcaaaccacaaatatttactatcctattctttccccaaattaatcagcaatgaagagtgcaagttaacatcctctaccactgataaactgtgactctaagcacctactacgtgttgtgattaaaaatgagaataaaattatataattacattaagtgctaaaaagttgaaatgttctatacatttctagatctattaaggattactgaaacatgaatgcattgataagctcttcaaaaccaattttcaaattagtagaagtattcaagcatcctgctccctagatatgaaaaacaggcattaaaattagggcatatatgtctgcaaagcattttctaaattaccacttaatcagattaacaaaggcaaacaaattcggaaaacagaaaagactaacaaatgtaaggtgttaaatatttggagtaagaaaaggggcctaaagcggcctagaacgatgaaaagcaaagcccctacggtaacgttacatttgaattaaagaataccgttatttaaataagcagttagcacttcgtaggaggaaggccaagcaacgtgactattacagatctatggattcacagcactgctttactattattccgtacttatttgcttatatttataatatagaaataaagaggcagcaacagttagccactacattaaccactctaccaaaggttacttaaaaaacggccttgcattcttacaacactctacagttaaggattattttcacatatatgacctcatatagtcctctcaaccctgcgatgttggtagtaccgactatatttcatagataagaaaccaaggctcggtacgcgattttttctcagagtcacccaagtcgaacccagaccttccgattcctagttttatgcctcgcattttgcatagttctatttcaggcataaattgaattgttaaagggaaggaacgggttaggcaaaaaataatcatggtacctgcagctgtgtgctgcaaaaaatggctgaattatgcttcttcctttttctttctcgctctctctggaaaaaaaaattacatttcaaacaatttaagtaaactcgaagacaaacgaggtcccggcgtctaccaaatgtttgactcgggtccgtgcagagagggccggcgaattcgtgcctagctcggggccgcgggcgaagcccgggctccgcaggccggcggccaggggcggctacgtacctcggggggtcctgtccagcctctagtggacggcagtctgcatcaggaagaaccgggccagcgggccgatgggtgggcggtcgggcgccgggacggcactcggcaggctcctcggacgtctacgagcagccgctcccggcacgagccgggtcgctccggcggggcacgagagtgctcgcctgcagccccctctggataagtcctgggaaagaagacagcgctgagtcgagaaaccagacagtcgggctccgcacgaggcggcgcggcgtcggggcccggaccgaccttgccaacgccgggggcctcgcagcacccgacggggctcggcgggagggccgactggggccgcgggcggggaaaagggctggggggcagcaggcagagacagaagcaccagccgaggaagcgtcgaggacggcgtctctgggcttctgccccgaagcgcgccgagcctcgggatcacccacgccgggggtggaggaaggcgggaaaggggcggggaaggggcggggcgtgcggggccacgagccgggggccgctccgggccgcgcgccccctgcgggccgcgggagccgcccggggcccgcccagggaggcggggctggccggcagggggcccagtgcgctgtcgtcttgacgcggaaggccgccacgctgggagagagggcggagggtgggaagccgttgggggcggggagctggcccgggaggcccccccctcggcccctgctggcgccccgagggggccagcccgtggcctggcgggtgtttaccttccccctggtcgagcgccaatgccgccatctttcagcccaaaacgcgtcacttccggcgccacgggagcgggagcgggtgtgggaacgggggggaagggggggcggggaaggctgtcccgcgcccgcggcgccccgcgtcccggctgccggcccgccacgccagcggtttcccaccgaggaaaacaggcggccgggcgtcgcggccctggactgggcccgacgcagcttcccccgcggcgccgccgtcggggctgaggacactcagctgtcctcgtccccttgcagcggtctctctccgcctgcacgagcgatgggccctgagccactgcggtgcgcccaccctcgacaagttgagggctaggaagccaggaaagtgtctttttgcatcttggccacggtgggggtgggggaatcggggacaacgtggagggagcttttccatagctacctgttataaaagtgactagatctgcgccaaatgacatcattttttgtaaggcaacttgcagtggactattgcgtcactgtccacttggcttactgcacaacaattacacgtttcagaaatcgatttcccaagggtgggaaaattcataaaaaattgcatgtctgcaccacccggagataatgccggatttaaaaaagctgtctctacttgcgtcaaaataatcaagaacgaacattcagagggcagtgatttttgttgttcgttttttatagaattctagctagtactttttaaatattaccttttcttgacaagaatataaaactagactataggactgttttgtaaatttattatggcatctctttctgggaaaagtgtagatgacggaaatacacagttggaagcccgtggatctacaattaaccttaaattagggcatccattgcccatagcagatcctaaactgaggtatttcggcttcccccacccccaccccccgccgccattttctctctagaccaatatcccgatgaactttccgtgagaggtgtcgctaaaagcgataattatctctttctagcaaacttgaacataccatctttcccaagaggccaaaatagcacacggtgtactgttttgctgaagtagactacttcgtgggagagataacacaatcacttcaatcttttggaaatacgcttccttattccgatttaaactataacaagctttaaaaaaactgtaagacactgaaattcccaagttgttcacactttctttccatcttttccaatagctcctttaagatatttctgttcattatttaaaaatccctgc

SEQ ID NO: 9828 - DNA, 1235 bp, artificial
  synthetic oligonucleotide
cgaaataatttttaaaatatccaatatgcttatattaaatcaaagaaacaaaataccttttattagtttatctatcagaaggggtggaagtgggggagcaattcctgaacttaagatggtgcctggccctattaaagaggttacctgtgtgaacaggcacctctctggccctttctacatccaaaaaatgctaacctaatcgctcgaatgacaagtacaaggaggtatcaagactgagtcttggttgtcagttttatcatctcttctccaccatgatgcaatcttcccaagtagttactatcgtggtgctttaatgctgaaacaaaccatatcaggccgggcgtggtggctcacgcctgtaatcccaacactttgggaggccaggcgagcggatcatgaggtcaggagttcgagactagcctggcaaacatggcgaaaccctgtctctactaaaaatacaaaaattagctgggcgtggtggggggcacctgtaattccagctactcaggaggctgaggtaggagaatcgcttgatcccgggaggcagaggttgcagtgagccgagatcgcaccgctgcactccagcttggatgacagagcgagactccatctcaaaaaacaaaacaaaacaaaaaaaccctgtatcagctacatttgatataattttgattctcagtaaaacatggagcagtctttagatgctatattgcaaaactatgtaccctggtatgagaagtctttatttgtaaaatcttgctcagaactaaagcttatattgatttacgtaaaacaaaatcatcacaaaaaaagctaggtgcaatatgcctttaatcaatccctttgtcctgaaaaactgagttaatgaccaaggataaagctatgaaaaatcagttcatgctaagcataaatcctttcagtcatactgtatttatagtcaataccaaatggtaaataaagataaatcgtagtaagaatttactcaccctcttctctccaagcaggcaaagtcaaaaatgaactgaacttcagaagtgaacttcagaagtaaagtgaccagggtaaataggggtgagggagaggtgccctcagggcaagagagttttagcacaatttggtaaagttctctatcccttcaacccttttagagagtaaaaaatacttaaagaataaatgtgcttacaaagtctaatttccttcaaatttcagtgcaatagtaatagaacactattagaaat

SEQ ID NO: 9829 - DNA, 2082 bp, artificial
  synthetic oligonucleotide
tatcttttctttagttgtgtaatgtataaagaaatttgttgtggggatgagggaggggggagggatagcattaggagatatacctaatgttaaatgacgagttgatgggtgcagcacaccaacatggcacatgtatacatatgtaactaacctgcacattatgcacatgtaccctaaaacttaaagtgtaataataaaaaaagggaaatatttatggttatggaaatgcttgccctgataaaaatcctacatattgtttttttaaattcacattttatgcttatacaatctctagagctcttactatgttgctataagacagtaatatagtgataatttaccaactttattgaaaatgttgttacatcaataaaatagcatgctggaaaaaaaagaagaaattaatgaaatataaagcaaaaatgatctacctaaaggaaagctccatatcacattttcactaaactgtttgtctcttcagttctatacgttaggaataaaacttcaaccattcaaccatttgaatgttttcttcctttttcattttctacatgtgtctgtgatattctaagctttggaatttaaaaaaataaataaaggaatagtctgaataacaaaagtgagaattggaatagaaaatgcattatagcttgctgttgtgtgttaagaaaaaagaacagtgattctcagttttgatcctgtctcaaccactctttcttttctctttttttttttttttttttgagacagcatctcactctgtcacccagactggagtgcagtggcatgatctcagctcactgcaacctccacctctcaggttcaagcatttctcctgcctcagcctcccgagtagctgggtttacaggcacatgccaccatgctaggcaaatttttgtatttttagtagaaaaagggttttgccatgtttgccaggctgatctcgaactcctgacctcaggcgatccgcctgcctcggccttccaaagtgctgagattacaggtgtgaaccaccgtgcctggcctcaaccactcttttaggccttgtatcaacattataacagagttcccatactttcacaaataccgcattctgacatacaaaggaagaaagaaacttaactggaatcaaaagatgtttgaattttcttttcttttcttttcttttttttttttttttttttgagacagagtcttgctgtgtcccctaggctggagtacagtggcatgatctcggctcactgcaacctccgcctcctgggttcaagcgattctcctgcctcagcctcccgagcagctgacattacaggcacctgccaccacgcctggctaatttttgtatttttagtagagacggggtttcaccatgttggccaggctggtctcgaactcctgacctcaggtgatccacctgcatcggcctcccaaagtgctggaattacaggagtgagccaccacgcccgccctgaattttcttttgtgctatccttcccttcatataaacataccctttgtggccagaagtacagatctgtaatataaatatgtgttagaagagtcagcacatacttatggcgggggtgcagagtacttaagtctctactcacagtctatgtatagctcttagcacaggatacttatatgtggaagggtatggtataagtagggcccaacaggatttgagcttccatatattctgtgattcttctgtctctgacctctcaggtgctttccttgagcataaaatgttgacatttgggagagaaaagaaaacccctctatttgccactttttagctgctgagaatgaagtctgaagggagggaggcttaaacagtctgaaacatacatgtttccacttaccagcagtgtattaacacataaaagagaggtggtactagtgacacctttcattgcagttcctacggtaactcgttgaatcaccagataagttttctctgcattgactgcacgaatgatattacaggtttgttttgcttttcaaaataaaagaattaaaagtcttttaaggggaaaaaccagttgttttaaaactatgttctctgaggattctggactcagc

SEQ ID NO: 9830 - DNA, 1302 bp, artificial
  synthetic oligonucleotide
tatgccttttgatgacaaagttttggccaggacttttttttttaatctcaagggaaatctcctcaagtatttcatatcctcattctgagtagattctgcaaatgaccacttccaattaccacatccaaatgttcctcattaggtcagtcttagagtgggggatggggaggtacaggaggaggaagcataaattgatagttctctaaggttttaggaaaatgaaaactactttataaatattaacctctttttttctctcagaatgcttaaagacatttcagctcaaataatacagagggcttggttatctcatacaaacaaaatgatatttcgactcctaaaacacgcaatttgtgcagcggtatgtattttgcttatttttttctctgagggatttaattatcaagctaaaagatctattaattaaagatcgaatagataaccttctttatctcctcttttttttttttttttgagagggagtctggctctttcacccaggctggagtgcagtggcacaatcttggctcactgcaacctctgcctcccaggttcaagcgattcttctgcttcagcctcccaagtagctgggactacaggcacctgtcaccatgcctggctaatgttttgtatttttagtagcgatggggtttcaccatgttagccaggatgatctcgatctcctgacctcgtgatctgcctgccttggcctcccaaagtgctgggattacaggcgtgagccaccacgcccggccctttctttatctcttctatttggatctaataatatcacgtggagttctggaattgtttcttctgttagccctagatgagtatttctggattttttaaaatgtggatgactattacttttttctgaaattaatatactgcttgccttgttttgtttttaaatttgattccttatttgaaaatgtgagacagttctcttccaacaataaaaagctccgaatctgcaaggtgcagcatctcacgcctgtaatcccagcactttgggaggccaaggcagggagggccaggagttcgagaccagtttggccaacattgagaaaccctgtctctactaaaatacaaaaaaatagccaggcgtggtggcatgagcctgtagtcacagctacttgggaggctgaggcaggagaattgcttgaacccaggaggtggaggttatggtgagcggagattgcgccactacattccagcctgggcgacagtgagactctgtcccccttcaaaaagctctgaattaaaagttcccttaccttttatccagcaattttactt

SEQ ID NO: 9831 - DNA, 1975 bp, artificial
  synthetic oligonucleotide
tgaggtttctcaggttttaaatttaaactaatatgctgtgtcctttaatcggaaaaggctctgaccttattttttcccgttaagaaacaagcggtaagcctcctctctggaaatcaaatgtttgtcccttaatacttgtagaagtaactgataatggcaataattatcttattaacaagagtaaacaagcactgatacagcactttgatatgcgcagccctgatctaagttctttattcacattcatctaatctttccaacaacggaagtaggtgggcatgattattattcccaatacatagatgaagaaactgaggcacgtagaagtaatttgtacaagaccacataggaagtgggaagctaggatccaaacccattagtctgcctttgaaacctgtgttctagccaaaacaattgttgcactgtctcataatgaggatgtatttcctatttcattctgtatttctgccctaatcctataaaaagtgtaagccccatccaggcgagcatctggaaaaatttagaatttgtacagtgacgtgccactgccctccagccaaagaccactaggggcacacctgtagttgaagaaattgggtttctcattgctgcaaggagaacgcacacgtaggaacacagtgacatatttcagtaaaagagttagatttattataggatttgggctttggttcggtgattttggggcgagttcaaggaagcaggagctttgctctggatcgggtgttgttaggaagcagtggtaacaccaaggcccagctgtgactgccagccttggtgttagttaagcccagcttagctcccagatgttaagggctgcttttctctttcttaagaggattgtatattccaaggcatccccaaggagaaatactgaatagactcagaaggctctctgcatcagcagtgtaacgtcacacatacataaaaatgtgaaacatattgataaattagggcagaagttcttaattcagggggtatgtgaacttgtatgggggaaaaaatgacaacttcattttcactaacctctaactgaactttgtttctttcaattatagtgtagataacaagccacagtagtattaacattgatgactttgtcatcaatggaaagcacagatattttcatgttacattgcagtcatgtcagggatcttgaaatatttatgctcgttactacaaaaatacagtagttattagagctcatttaatgcattaagaagacacatttactataattttgttttaaaaaatattttgatgatttcaatataattggagcaccttgtaatcctatgtattttatgttatgcgttttaaaaccaattcttagaagagatctgtccataggggtccatggcaccaaaagaaatgataaagagcccctggtttagtaacagagaccaagcagtgagtaagaatttgggagctgcatccaaattggagcattactgcatccaaactcgttgctttaaagaatagaaagttggaggtggaatcagaaatttagtgtataccctctcactttaccaaggagggaactgaaccactgagaggttaagtgacttgcccaaagtctcactgctatttggtgataaaactgggacaaaacgtttttagacaaacatgtaaaaactctccactgtgctaggcactgaggactctgtagttaacaagatgcctcctgccctcaatgagcttgttggtagacagctggagagtgaggagattgaattattgagttaaaaagttaactccaggtgtagtgtggaagatgaataagaggagaaaaagactggagacagaccagttagaaggctatggatagatttacttgtcttttccatataccatataatatttttagtacacaaagaatgtaaactgtaagcaactttaagagatccacaatgccttcctttttaaaggattcagaattagtacaacaatcatatgg

SEQ ID NO: 9832 - DNA, 1766 bp, artificial
  synthetic oligonucleotide
gggaccaaatgctgcagtccttcctagcattagcttcctttcatgttcaggcttctggcatgagttgatgccagaacaaatgtgaactgcacaaagatctgtcttgaattttggaactgtaccagtttaatttgagtcacctcacatctgtatttaattttctgcctttttgagtttctccagttatcctggaagcatagcagcgtgtgtgtccttgggtaggacccacttgctgtgcattccactttgcacattgagaaaccaggcccagagaattgagtgacccgtgcgggctcacacagctcgagacagacaggctgggcactccattcctggaattctgaagcccagcccagtttctctccataaaaccacagctgccccaggccccagccctgaaaggaaccagggcttgccatggctcagacacacaggtctgattgtcctggctgctccagtgggcaccaggaaggcctcagggacagtgtgattgtatccctgataaggaagaggcctgatgttctgagcacagagtggaccccaaggagcaattcccacgcctggatggacccacacagggcagggggagggtgggggcctctgcttgtgtcctcctgaatgcagagcatgagcttgggcctcctagaacacaaactttgcttgtttggtacaaatggggtgccgtggtctgttgctcaaatggaggagggaggggtacccttagtccccaggccagcatgagcagaatgtgggctttggagtcaggaagacccagacccaaattttgcattttgtttcctggctctgtggccttgtctagttcatgcaatgtatctgtgcctcagcttcctgatctgcaaaataggggtgctgacatccacttcccagggctgctgtgacaggaagacaagccccagcacaaatcctgctgtgatgtacaagctgtgcccttccctcctttcctcccccaacacacacaaaatgagtccatcaccggagctgcagaaagaaagggaagaaactaacgttctttctgcgtctgggagcttgtgggggcgggcagggggtgagggagaaatcatggagtcacgtggcagccacagacttactactactactttgttagctccaatagtgtatcctctcaggccattccgtttcctcagcagaggtctaacacttgttgcaattagagaccccaaacagagacctaagcatgctggacaagggggtggagatgcaagccggcctgacaggaggggccttgaataggggagggacggaatagagacgcattgcggaaaaggtagggggccggtgtgtggggcaaggggtgggaccaagaggcacagcgcatctgtgggggagggggcgtagaggaaggggaggtgctgttgtatagtgtcgacctggttggtggtggggtggtgtgttggcaaagggggcgggaccgccttccagcgcacatgcgcatcatggtctccaggacgaagcttttgttgggaaagcaggcgggactgactttggctcttcagtgtttgcgcatgcgcgtaacgtcctgaggcggtgggtggtatattaggcgaagaggcggggtcgcccaagctgccgcgctggcattttctcctggacaaggagagagtgcggctgctgagagccgagcccagcaatcccgatcctctgagtcgtgaagaagggaggcagcgagggggttggggttggggcctgaggcaaggtgagaattagcccccagactgggcatctgc

SEQ ID NO: 9833 - DNA, 1920 bp, artificial
  synthetic oligonucleotide
ggtcttaaggtctttgttcatctcagaagtcttaattggtttaattaggctgacacctacagccctgtctcattaccataaactgtagaggggttcaacatgacactgattgtttcttagagcaaagccagtgcagtgagtaggattccaggccccccggaatgaagcaggaaaacccgaggcctgtggatgcaggatgtactagggaggtgctggggagtagtgcagataaacccagaattcagttggttggtaaaacaagagtgatctgagtcctgtgcttgtctacgtgatccaccattgaatggcaggccagccattgtgcaggcatctgcatatgaagtgactggaagcttcactggaacaaggatctccttggaaattctctcccctcagacagccagggtgcttaacatgaaaagaagttgtaaccctatccttaaactatagaagccatcagcagaagttacaggcttatgggggcccactggaaagggaaaatcaaaaggcctgtggatttcaaattaatgagtgatcttaagttgcatttcctaagttcggctacagactcatatatttcatgagtccctccctacccattccttgcctctcccttcagttgctgggtttctgaatttctgtatagttaacccttatcttgcctcccatttgttcaatagaaatgatcacttttacttgaatcttttggtagaattgtataccatgtgttcctgtctaggtttaatcatcagattgtggtcaaattgctctgccagactgtgtgaacaaaaaagtgaatggaaattttcgttttaaaaaataatacttttggacttagcccgtggctaagaagaagtaaggaagccaagcgtacggatagcagcgaggggtcaatccacgcccggcgttgggtcgggggtggaggagtcggaagtggttggggtttgggggaggagatccgctcacacacaagaggagagtgttgagccgccatatctgctgctgccgccgcagttgcgaatgcagcatcggcgcttagctgcctccgcggtgcagctaaggttcgtgtcgctaccccttggcccttcgctcttgctgccttaaccccgccggcggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgagcccctcagctcggctttcagccgtaagctcaacgtcaacgccaagcccttcgtgcctaacgtacacgccgcggagttcgtgccgtccttcctgcggggcccgactcagccgcccaccctcccggccggctccggcagcaacgatgaaacctgcaccggcgcgggataccctcaaggtaaaaggatgggacggggggcacctgtggaaccttcccgagaggaaccgttagtgtcgcttgaaggttccaattcagccgttaccatggaactttcagaacctgttgtagaaaatggagaggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgacaaaagaacactggagaaatatgaaagagaagctaaggaaaaaaacagaga

SEQ ID NO: 9834 - DNA, 503 bp, artificial
  synthetic oligonucleotide
tttcatgtccaatattactctttctatattttctgttaagacaattgccattttttttatttttctagttttcagttacagcatctactcattggccattgagaggaaggagaatttgaaccaaggcttctccccagggacaccactggttacttccacagaatggggaaagtgaacttaccttagaatttgggagaggctttttcaaaacacctcgtgtgtgtgtgtgtgtgtgtgtgtgtgtgtgtgtgtgtgtgtgtgttcagcaaataaccaaaatcagcaagggaaagggaaaagaaaagaagaacctgctaaatgaacatgccatgtatcagaacaaacagaagggaacaaaagctctacttacatacagaagacacagcttacaacgctacactacagatcctgtaaaatactgaatattggccccccacacagttcagtcctgcactagactatgccagactgttttagagaaaatttatctaaattctagagag

SEQ ID NO: 9835 - DNA, 1782 bp, artificial
  synthetic oligonucleotide
ccctctttgctctggaaatatttgtactcatatagcatatttcaaaaatgttgtcattcattaaggcctcttaaatagaccactattttttgtgtctggcagatgagtatgtcaaggattgagatgaacacataagtcttggaaattaaataaatttataaacataaagataatttaatgctgtgacttcattttttaaattctttaaaccaactttctcccaataaaaaattataaactatgtcttttcctacttactcctggaattttcaaaggaaaattttacgttctcaaagggaacagcttttatttgtccatgggctcacaaagtttcactgaacaaatttgttcaaatgatttctctttcaacatcattttctagcaaaatcatggagaacagctttacactttcaaggtaataggtataattctgttggtggtgacaagctgcacttaactagtctgaaaaaagttgccatcactccttttaaataatggtacttgttttaatttcatcctgtttcctttctgcttctcctcaggcattgacttattaaaacttctcgtcaattgcaaacacagtaacataatggcttaaaaagaattatgtttctaggggctccattgatcatgttggtcataagctaaaaatacactgacatttgtattttttaccaattagtataattaatacaacaaaatgcttgagtagtagtcgagaaacatggatagactatgaagtttgtctctgtgacctacattgttcatgttcatgtccaggaaacatataagaaagcaatttgtaagctggagattatactgtatatattccaaattaacaaatatttactgagcgtcattgtgaagattacaccataacatattgaagggtctgtgagaggagtactatataaccctgacctttaaagagatcgccattgatgggaggagatagaaaaataatatattaaactattgaagaacaaaaacggaaaaatgtttactttggcaccaaatgaaaatgattaagaggttaacaaaaaaaaagcagtaagaataatgagacatttattctgggcacagagaagagccaccaaatatgttttaatagaggagtcagacaatgaaaattatgttttagaaaagttaatgtcatgcaagtgtacaatgtggattagatgggaaagaccggaataggaaaatcagtgagaaagcttttgcagcaatcaaggtgtgatatgaaggatgaagccaggactaggatggtgtcagtggagaggtattggaaatattttcaaatatttccagtatttgaagacagatttcaaatatcagataatttcaaatatctcttcaaatactgaagagaagaaggaatattacttagtacctcattgcggtggagtgggggggaagaaaagagggagggagggagagagagatcatcatggaaaccaagaatggtaactcaggtttccttggggactataataatcatatttttactaacagaatgagggaagtaagagttctttctgagaatcagtgtataaagatggtgtatttagttaaacaataattgttaaagcattgttatcctgcatgaggatacattataacgtggatacattgtggtttatccactttctagaagacagcaaaaggctactttttttttttattttttttttggcagggggttcctttaggcattctcagaactacctacacagttatgatcctcttacctccttttgaattacgagagacctccccagcttg

SEQ ID NO: 9836 - DNA, 1584 bp, artificial
  synthetic oligonucleotide
aaagtaaatttttatagagaagtctcccctctcctggaaaagatgggtcccaagtgggcattgttagaactcagtaagcacatacagccccaacccagagcaccattaagacctgtagtttaaagctatatccatagctttttatcaagggtcaaagagtatctcagtatcaattaccaaccttctgctcaggacactatctgtggtgctctttgaggtctcccaggcccagatctggctgattccactgtctatacttttttactttgcagtcttcttttcaggaactccatgcctggcttttcccagaagcagatcgctgacttttgtcccccatttagtccagctgatatacctgggccctcaggtcacaaggctcagctataccctggacaaagccaatctaggacctagtggtcacaaaaacaactaaccaacttgcaagcctgttgtcagggcctacttagaatcaatgactgtcagaattggacagaattttaaagatcatcaccttcatgccctcattttatagatgaggtttaacaaaagtaacttgcctacagtcatcaaatggtcagccttctggactagtgttttttctaacataacaccacagagagggaatacaggtagaaaaaataatctgaatttaagaccttgttatactactagctaaaggtgtaatgataattatgatgatgttagctaataaagagcgctattatgtcaggcactattctaaacacgttatatacattaattcattcaagcctcacagcagccctttaaggaaaaactattactattcatatcttacagatgaggtagctgaagctcaaagaagttaaataatttgcagttcacacagccaataactactgaagccattattccagtagaggcacagtctggctctagagactctgctcttaacttataaactattctgcctctgggtcccagtttcttcacctataaaatggggataattctactctaccatctgctttgtagggtataaaacactgaactgagagctgacaggtatgtgcatggaggtgagaggaacgctaatccagaaggcgttaacagctgtgtggggcttctgtgttctctcctcacaaacacaagccggagcaaagggatgttcctccctcatcttctgagttgttttgaaaatgtaaactaaacttaacctggaaattggttccaaatcttccatttgtgtacagaattaacttttaacttgctacaatttttgttaaaatgcactttgctctgctcatccatcttccatccaacattcattcattgagctcctactgtgtgcagggatctgctcactgtgactcagctgcagtccttacctgaagaacaaagggtttccaggtaccaacaatgcatatctttccagcaggacgcaaaggtggttttatgggcacgcatacctaccttcgattctgggctttactactttagaaagtagcaatgacaataggaggtgaggaatagaagaggagtcagaaacacaaacttaaatgtaattgtcagcatgtaattatgacatctaggagtataatttca

SEQ ID NO: 9837 - DNA, 822 bp, artificial
  synthetic oligonucleotide
aacaaggtaattgatgggtgggggctacgggtgggagtgggggatggaatccagagcccttacagatgaattaacctttgctgggatgagggatcaagacaagagggaaaaatgggtggactcagtagagtttgttgttatggaaggttgaagatgtcactccttatgacctctacctgctctgggaggaaggaggcaaaattcctagttgacagtgagaggaaaagcagtactagacggaggttcaaggaagtctgttaatattggacaaggtttgaaatagccactgcagacaatgggctagttggtaaaggtccagctaggctgtcacccaggaatgtatagccaccccattctgtagttttgtgacatcctgcttcctagctgtctgacctagagcaacttcacttagcctacttaacttcactgcacctgaatttcctcatctataaaatgggcatgaataaaacaaagccattgaaataaatgagttaatccatgtgaagtgattactgaggacactgcctggaacatataagtgcttgatggaaatcaactctttagagttatttttatttttgattgacaaatcataattgtgtacacttatgggatataatatgatgttttgatatatgtatacagtgtggcatgattaaatcaagctaattaacatatccatcaccttgtttacctgtcattgctttatggtaagacatttgaaatttactctcttagttactttgaaataaatcatgcattcttattgactatagtcaccctcctgtgcaattgatctcaaaacctatttctcctgtgtat

SEQ ID NO: 9838 - DNA, 385 bp, artificial
  synthetic oligonucleotide
ttggaactgtagtaatccattatctgcctagcttaattgtagaataacttgttacatgtaaatatatgtattgtaggaatggtagcttttcacttcatgggagaaaatattttcagttttgatgagtacttatagaatctttgatttcacaatagaaaataccaaatgtattttgacttttttttgttcaaccggattatcattaacattctttaacgctattttccagtttctcccttctttcatagctgtcacttgtcattgtcattaaacccaattctagtttgtttaactaaatctagcacttaccagcaaaagaagtaaccaaaattttaaagagttgtatgttaatataagtgaatagacttgaatgacagtcaaaggg

SEQ ID NO: 9839 - DNA, 988 bp, artificial
  synthetic oligonucleotide
agggtctggacagttcagtgttctgtgaaagcttttgctgggaagcagaaaggaacttgaacagtagtcaagttagagccatctctctccctcataggagactctttcttgaccttgacatccattttatcccattcgcctttttccccaggggccagaaatgagacatctttgggcaaggaagccagagcactctgcctcctgtctcttgactgagggccacttctccacagctctttatctcctgactcatctttgcttttttcttttgtttttgttttttttgagatggagtctcactcttgcctaggctggagtgcagtggcatgatctcagctcactacaacctccgcctcttgggttcaagtgattctcctgcctctgcctcccaagtagctgggattacaggagcccgtcaccacgcctggctaatttttgtatttttagtagaggcgaggtttcaacatgttgaccaggctggtctcaaactcttgacctcaggtgatctgcctgcctcagcctcccaaagtgcccacctcatctttgggaagttgatagaaaggggtgggggcagagcctttccttagcgttgggggttccttaatgggaacccaggccaagaggaataatatgagatttcagggcaggctactgaccccaagcctcggatagtttagcaaaacctaaatgaagggtgtagtcagcttcactacctcagcattcctggggctgtccagcagggctcttctggaaagctgaggccaaacagagagagagagaagaaaaaggtccaacacggtggcagccagtcagaggtgactttggaagtggagcaagagatcccagaacatttgagaaagttctttataaacagctcctagattttgaagggagtggttatgaggaatgtttgctgggatgagggtttagggaggccggggtgattcagtttcatctcctctctttgatggaaccatgggatctcagc

SEQ ID NO: 9840 - DNA, 1428 bp, artificial
  synthetic oligonucleotide
tattcccagagccagcaagggccaagcctcattttcctgggggcccaaatcctcccccattttccttccatccaggcttcaagccagaggccaaacgggggtcaaggatgacggctcattggcagggccaagcaggtggccctgccctaggttcagccctagggagcttcttgttttctcctgaacttccaagaatctccattcccagatgaggcatgctgtcagatcttggcatatgacaccaaatatgtccccctttccctcttctgcctgagtctaaatgtcccttttcctttgacctacaatgtagaagattcttgctaagagctggatgaggaaggcttcatggggtggggcggggcggggggtggtgggtcgcatcaactagagtgcaattctatgtgcgaagagggaaaagcccagcttccgaacctccaagatagcttgtttaaaatttctattgaaagaatctaggggtatttacctctcagctctggacgctgagttttcagacctgcatattttgggtagaagggcctgtgtcaggctgtgaagccagttcctggcaggccaaatgtggcaaagaaccattcagtaaagcagccagcccagcaacacaggcccaggaggcagcttcggagctggttcagctacagaaggtctgagacgcctcttccaagcccctttaggaagcctgactctctggctttcaagctgcctgctgtccccaatccctctctttctggtgcagacactgaagaaaacggttgtctcttgtttcctgcctggagcagctggggctacttgaatattctgcgggatattcctggaaggtgacctccctgtatcctcctctttcggagacaaaggcaaagcaggatgtggttgggaattacacttttaaggaacaggaccattaggtgacgctaagcctcttagccactatgtggcgccatttacccatttttctgtgcaaggttagtgggcggtggctacacgcaaagcaaaccaaatatcaaaactcgaaaacttttcagggatctagttctgactaggctcctaatatgttgagggtacttgggcaaatctcttgacctctaggcgcctcagttcctcattttgtgaaataggagacagatggtgggggggtccctgaaatcccttccagcttcataattttgcaactatgtgagtgaattcccaatgaacatccaagcgatgcaattttgggcctttgggtcacacacagggtgggtaaaaaaaaaaaaataaaagcgcacaagggccaaggcatgggtttgggggtgagggtgagaagggggtggtcatggaagcagggatcctctacaacacatgggccaggatttttcttgagctttccatggcgctagggaaaagataaggagccattcatttgcttagtaaaca

SEQ ID NO: 9841 - DNA, 654 bp, artificial
  synthetic oligonucleotide
tgcaagctctccaccccaagcagcatcttcacgggaacctggcagccttccatcttcgtatcctcaaactggctggccttgtccttagaagtctccatactgtcctgcagtttgcttctctgattgtgtctagggagtaggtaccccaccttctgctggtagagtcttgttttcctaaagagttgagtcttttgctggacaagtgtggagccactagtattccatttcaggctttaaaaaatggtctaatttgtgctcttgtttagccagttctcagtcctcagacatatatcctagtccttactttgctaatttatgaagttggaggagacttataagacgagcttaaaagaagagcttatgcctactatcagaatttggggatagttggatatagtcagataaaagtggtttgaagatttctgatcatcagtcggtattaaggtaatttcaggaagaaattcccaacagaaagtgattacagacatgggattcagtccccagtgaaagtaatgtattatttttcttaattaccaggggagttgccacccagctgtctaagattatgcaaattgatgatctttcagtgttttctccccaccctacagccactccattacccttaaaacctattttttgagagtccataaccct

SEQ ID NO: 9842 - DNA, 915 bp, artificial
  synthetic oligonucleotide
tgtcagaccttaaattccgaagatctgagagaggaagataattcacttttactcaaagtaatggagtccagacctgacttctctagcattatgacctggcacaagtatatttaatcttcttgggctccattcctaagctgtaatataacagaatagaacttgataaattcagttccattcagctctaagattctataactcaaaaggattaatgcagatctttttccagaaatatttttttttctttatttcttctaaaaaaagaaagggtggggggatacatgtgcagagcgtgagggtttgttacataggtatttgtgtgccatgctggtttgctgcacctattgacctgtcctctaagttctctctcctcatcccccaccccacagcaggtcctggtgtgtgttattccactttctgtgtcaatgtgttctcattgttcaagtcccacttatgtgagaacatgcggtgtttggttttctattcgtgtttgctgaggatgaaaggaaatttttgtttggaaccccaatcactaaaattggtttcccaatcgataaaccaaactaagtagaatttcaataataaactgttgtaatagcccccactcaactcagagtgatattcatatgtttaaaaaaacagttaacttttctgcaatattccactgaattataataatgcttgcagaaataaaacagtcatacttacacatgttgagctgtcggaagctggtcatattattttgcttcaaatattttggaaagtctttggcaaaggtttgttcattcataatatgaaagctctgaccatactagaaataagggaacaccaaacaatggtcttgaaatgttgcaatgaagtttcaacaaagcaacaattcaacaacaatgcatcagaagccataaacttcaaaga

SEQ ID NO: 9843 - DNA, 955 bp, artificial
  synthetic oligonucleotide
ttgaaaagtaagaaataatgaatgaataaggaaaggtaggttaaaaccatcctaaattatagccccttgttataagctatactagaaatatccttccatatgtttctttgaatgtttttataaacctttcttcagaatatatttttaagttggggaattgctatatcagaggctatgtacattaaaatttttggtacctacacccaaattactctctggaaagatttgcagtcctatcagtttagagttccattagcagtacctgaggaggactccttttcttacaacctcatcagcactggggaaatctttttaatcttgtcaaaatgacagtcttgtaggcaaacgacagcatcaacaaaactcactgttgttttgatttacatttgtttgattatttcatgttgaacattcagtatttattgcatatattattctacttgtgcatatgaaccttttaaagaaatagctttgtctacattttggtgtactttttttttttcaaattttgtctatattttttttcaagtgttattcccttttacatttacactctttataggtgagtgagtagggtaggtgccatctaaaccacttcttaccatcatgcattattacaatttgtaaaatctttgctaaattaatttgtaaaaaagttatctagctattttcaattgtacttctttgattactgatggcatgaaaatttgaaaaaggtctgtgcattgcttgaccatgtcttgtgtccattttagaaattacagccttagtgttttatatatatatgtatatatatacatacatacataacatatacacacccacatgtacataatacatattaaaagaaaaaaattaaataatcagagctgttcaaagatgacatggactataatggcaggtagtgagtcccccatcactggagagttttaagcagaagtagggatgtaagagc

SEQ ID NO: 9844 - DNA, 11966 bp, artificial
  synthetic oligonucleotide
acaagctgagattgagccagagtggcatgacgttatggggatggttgtgtgggggctgaaactgagaatcataaagaagtgaggctaggcccaacaatttcattgcagtggaggcagagtgggaagtttaaggaatttttgctccaagtttactatgaagatttttagagactctacagcaactgtttccacagctctccttgatctcttctgtggcctgcctatacacaggattttgatctctatcaagataatctgaacagtgctgatggggctgccacatctccagagccctctgccctagggaatataacagacctaccacttatgttactttaacgttgaatgggatgttatttataaataattgtgaggtaaaagttagatgcctggttttatagagtcaagggataatgactcttttgggaaacaaatggaacctaggaaggaatcttggtctgaggacagaagctagacattgcacctttctgaaataagccaggcacagaaaggcaaacatagtatgttttcacttatttctgtgatctaaaattaaaaataattaaactcatggtcatagagagcagaaggatggttaccagaggacaggagcaaaagtaatgccaatttttaatgcacgttcttccacatagaatgccctctttttatccttctgtctctgtagcagctctccatccttggaagaggaccttcctaattacaccagctttcagtgacctgagcttccacacttccatgccacaaagaacctgtaccacattacatatcacttagtctattgtattgtgagctgtttacaaattgtgcccaggggggcagatggcataggatactgatcaagaacatgagacatattcaggcacacctgtaataaattcctaccccacactaactagtagtttaacttagggttgcatttggctgtaagtacgagaaacccaactatagtggcttaaaaaaaagaagttgttttttttttttcctcacatatcaagaaatataaagtggttgctatggttcagtaactcaatcatttcagggctgaggtaactgagatacttatggtatcttcctcaaaaacacaaaatgattactgttgctgcaaccatcataactgtatttaaggcaagaagaaggaggaagaggcagtgctcacacatttgtttttttaattttaagtcttttttttttgtgagtacatagtaggtgtatatttttatgggatacatgagatgttgtaatactggcatgcaatgtgaaataagcatattatgaagaatgccatatccatcctctcaagcatttatccattgagttatgaacaatggaattataccctttaagttgttttaaaatatacaattaagttattattgactatattcaccctgttgtgctatcaaacagtaggtcttgtttattctttctcactgttttttgtacccattaaccatccccatcaccccactcagcttctcactaccctttctagcctctggtaacaatccttctgctctctatgtccatgagttaaattattttgatttttagatcacagaaataagtgagaacatactatgttggtctttctgtgcctggcttatttcactcaacgtaatgatctttggttccatccattttgttgaaaataagtggatctcactcttttaaatgactgaatagtacttcattgtgtatatgtaccacattttcttcatccattcatctgttaatggacacttaggttgcttccaaatattagctatatatagctatatatattagctatataaatgacgttgcaataaacaaagaagggcagatatatcttcaatatgttgatttcctttcttttgcatatatacccagaagtgagattgctgacttgtgtggtaggtaaatattttgtttttttgaggaacctccaaactgttctccatagtgcttatgctaatttacattcccaccaacaatatacaggtgttccctgttgtccacatccttgccagcatttgttattgcctgtcttttggatataagctattttaactggagtgagataatagctcattgtctttttgatttatgtttccctgatgatcgatgatgttcagtatctttttacatgcctgtttgttatctgtattacttcttttgtaaaatatctattcagatcttttgcccattttttgatcaaattattagatttctttctataaagttctttgaactccttatgtattccgattgttaatcccttttcagatgggtagtttgcaaatattttcttcaattttgtgggatgtctcttcactatgttgattgttttctttgttatacagaagcttgttaacttgatgtgatcccatttgtccatttttgctttggctgcctgtgtttatggggtattgctcgaaaaattttgtccagaccaatatcctgaagatttcctccaatgttttcttatagcagttttgtagtttgaggtcttggatttaagtttttactccatttcgattccatttttatatatggtgagaggggagtagctttattcttccgcataagaaatatccagtattcccagcaccatttcttgaagagacagtctttcccagtgtatgttcttggcacatttgtcaaaaatgagttcactgtgggtatgtagatttgtttctgggttctctattctattctatttaggtgtcttttttttttttttcccagtatcatgttgttttgtttaccatagctctgtagtacaatttgaagtcaggtaatgtgattctttcagttcggttctttttgtttaggatagctttggctattctacgtcttttgtggtttcatataaacgttagaattttttttcctatttctgtctaggatgtcatcggtatttcaatagagattacattgaatctgtagattgctttgggtagtatgacaattttaagaatattgatttttttttcaatttatgaacatggaatagttttccatttttggtgtcctcttgaatttctttcatcagcattttatagtttttattataaaaatcttctagttatttggttaattcctagatatgtaattttatttgtggctattataagtggagtttaaaaaatttgtttttcagattaatccctgtaggcatatagatatattactgtttttgtatgctgattttttattctgaaactttattgaatctgtttatcagttctaatagttttttgtggaatatttaggtttttctaaatataaaattttattatctgcaaatgaggataatttgactttttaaattccaatttggatgtcttttatttctttctcgtgtctgatttctctagctaggatttccagtactatgttaaagagcaggagtgaaagtgggtgtccatgtcatgttcccaatcttagaggaaaggctttcagctttctcccattcagtatcatactagctatggaactgtcacatatggcttttattatgttgaggtatgtttcatgttatttaatctatcattctgttgatatgatgtatcacattggttaatttgcatattttgaaccatccttgcatctcagggatgaatcccatttggtcatgatgaatgatattttttatgtactgttgaatttggttggctagtattttttttattttatttcttactattatactttaagttttagggtacatgtgcacaatgtgcgggttagttacatatgtatacatgtgcaatgctggtttgctgcacccattaacttgtcatttagcattaggtatatctcctaatgctatccctcccccctccccctaccccacagcagtccccagagtgtgatgttccccttcctgtgtccatgtgttctcattgttcaattcccacctatgagtgagaatatgcagtgtttggttttttgttcttgcaatagtttactgagaatgatgatttccaatttcatccatgtccctacaaaggacatgaactcatccttttttatggctgcatagtattccatggtgtatatgtgccacattttctcaatccagtctatcattattggacatttgggttggttccaagtccttgctattgtgaatagtgccacaataagcatacgtgtgcatgtgtctttatagcagcatgatttatagtcctttgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgaacattttttcatgtgttttttggctgcataaatgtcttcttttgagaagtgtctgttcgtgtcctttgcccactttttgatggggttgtttggttttttcctgtaaatttgtttgagttcattgtagattctggatattagccctttgtcaggtgagtaggttgtgaaaattttctcccattctgtaggttgcctgttcactctgatggtagtttcttttgctatgcagaagctctttagtttaattagatcgcatttgtctattttggcttttgttgccattgcttttggtgttttagacatgaagtccttgcccatgcctatgtcctgaatggtaatgcctaggttttcttctagggtttggttggctaatattttgttgagaatgtttgcatcaatattcagcagatactcgtatgtagttttccttttttcatgtgtctttgtttcactttggtatcagggtaataccagcctcttagaatgagtttgggagtcctccctcctcctttattttttatgaaagtttgagtaggattgggattaattcttttgatatgcttggtagagttcaggagtgaagccatcagctcccaggctctcctttatggagagactttttattatgactttgatctcattacttgttattggtctgttcaggttttaaatttctccctggttccatcctggtaggttgtatgtgtctaggaatttgtcaaattcatctagattttctaagttattggcatttagttccgcatagtagctactaatgttcctttgaatttctgccatatcagttgtaatgtatccttttcatttctgattttatttatttggatcttctcttttttcttagtctggctaaaagtttgtcagtttggtttaactttttaaaagcacaactttttgttgaattggtcctttgcattttttaatatgaattttatgtattactgctctctttattatttcttgttttagaagtaatttgatttttttttgcttttctagttccctaagatgcattattagattgtttactgaaagattttcctcttctttgatgtaggcttatagctataaacttccctctgtgtactgctttagctatatcccattggttttgatatgttgtgtttccattatcatttctgtcaataaatgtttcacttttctttttaatttcttcattgaccctctggtcattcaggagcacatggtttaatttccatgtatttgtataatttccaaaattcctcttcttattgttttctagttttattccattgtggtcggagaatatgcttgatgttatttcaattgtttttgtatgttttaagaattgttttgtgacctaacatatggtctatttttgaaaataatctgtgtgctgagaaaaaggatgtgtattctgcagccattggatgctatgttttgtaaatatttattagatccatttggtccgtagtgcagattaagtccaatgtttctttgtttattttctgtttggaacatctgtccattgctgaatgtggggtgttaaagtctccagctattattgtattggggtctgcctctgtctttagctctaatatttgctttatatatctgggtgctctggtgttgggtgcatagatatttaaagttgttatatccttttgctgaatggaccactttatcattatgttgttgttgataagtaaggacttggttatgtcattttgttatttgttttctagttgttttgtggtcttcttttccttccttctttctttccttcctgcactcctttattggtaatttttctctcatgacatgacttagtttctttcttttttgtgtatgtgcatctgttgtatgctttttggcttgaggttaccgggaggcttgaaaatattatcttataacccaatattttaagttgatattttaatactgtttgcatataaaaacaagcaagaagaaaactaataaagacttgaatccttaactttacccccctacttttcaacattttgttggttctatttatatcttattgtactatctgtgtcccaaaaagttgttgtagttattatctttattaattcatggtttagtatttctacttaagagtagtttacagaccacagttacgctgttatgatgttttgtgtttttctgtttatttaccattaccagtaagttttgtaccagtaggtgcttacttactgctccttaatgcccctttctttctgattaaagtaatcccttgagagtttcttataaaacaggtctggtattgatgaaatccctcagcttttgtttgtctgggaaagcctttatttgtcctgcacgtttgaaggatatttttgccagatctactattctaaggtaaaagttttttcaatcagcactttaaacatgtcatggacctatctcctagcctgtaaggtttccactgaaaagtctgctgttcagtgtattggagctccatggtatgctgtttgtttctcttctcttgcagcttttaggattttattcttgacctttgagattttgatgactaaatgccttgaagtagtcttcattgtattcaatctgcttggtgttctataaccatctagtgtttgtatattgatatttttatctaggtttgggaatttctctcctattactttctgaataaactttttatctctatctgtttctctacatacttttttagtccgataactcttagatttgcccctttgaagctatttgctagatcctgtaggggtgcatcattgttttttattctttttcttttgtctcctcttactgtgtattttcaaatagccttttgttgagctcactaattgtttcttctgccttatcaattctgctgttaaaggactctgacacattcttcagtatgccaattgcatctttcagctccagaatttctgcttgattctttttaattatttcaatctctttgttaaatttatctgataaaattcctgtgttatcttgaatttcttagtttcctcattgcagctgttttgaattctctgtgaattcaggcctgagacagacctgaagccagcacagtcctgggtcttgcccaaggcccactgtaatcactcactggcaactgcctgtgttcactctatcccctggggttccacagccacccatggcaaagccagtctggcctgtgttcttcctttcaggatgataagttccctcaggccctgagtaggtcaataggtgccatccatgagtgagggagtagagtcaaacaccttagaagtatatctggtgttttactgtggcttagctggcactaaaaccacaagatgcagacctttccactcttccctcccctttccaaagagagatgaccctcaccctgtagctactgcaaccccaggccaagaagagtactgccagattatctcagatgttcccttaaggcctaagggctcttaagtcagtttgtggtgaatgctgccttgcctgagactcaccattcaaggaagtgggctcccctctggccaagggcaggtatagaaatgccattcaggagtcaagtccttgaatcagggatcccaagagcccacttgctgttctaccagtctgtgtctgtgctggtacctaaggtgcaagacaaagtcccctttacattttcctctgcttttcccaagcagaaggagttttaacccatagccaccacagctggtaatgtgctgagtctcacttgaagccagcaagtcacagaggctcaaccaaagcccttgatgtagtaactgaatatcactgctctttattcagtatgggagagttcttcatttagtagatgataagtactgccagaaccaggtccttcccttcaagtcagtgtgttcttttctggcccaaggcatgtctagaaatgttttccaggaacaagggcctggaacagaggcctcgtgactctgaccagtaacttatcttgctgtggctgatctgatctggtatccaaaacataagacaaagatctgttcattttcccctctcctctactcaagcagaaggaagaggtttcttttggagccatgagctgtgcagcctggatttaagggaggggtgatgccagcactcccttggctgccccagctggtgcctcagtatattgtatgccccttcagtccactttctctggtactaattcagtactaggactcacctaagatttgctgtccttatcgcctaggctgccttttaaatttacttggagacacagagcactgtagccctcagtggcgaggtttaccagaactcatgtttagacctctgggattggagagtcccctctggctagggattctttaaatgccctccgtgggtgggcatcaactgagtttggtctggttttcctttctgttctaacaggataacattgagttcagtgcctcacaatttctgtgttctccctaccccagcacccagaaaagctctctgcaccaggctgccactgtcagggatggagaagggatggcgttagtaattcagaactgttttttctatctcttcaatgtctctttcagtgatataaagttaaaaccaggtactatgcatgcttagctaatttttgattcttatgaaggtgtttttttttctgtgcagacagttgttaaatttgtgtctttgggggagggacgattgatggagccttctattccactgtcttgctcttcatctgtctttttaaaataagcaaatacataagctttcctagaattcccagcaccctttcccttaggtctatttggcaagacctatatcatatagtacttctagccacaaaggagccttagaaagcaggtattaaggtttttagcctctatatagtgagaaagagttaagaatgagtatgtattcacctttgtattaatcatagttgaaatttttccatcccaactctctacatatattttcccatatctctatctttcacagatacataaagtagaagctgatgttatgtttcctaagcagaaactgattccagaggagatacctcacccatgctttattattcgtattcatactgataactgacctaaggacctgcttgttacatgcacattataacatccaattgactggaatgcccagagtgtactcaggtgtttttttttttttttttttttttttttttgcggcttgaatgcctgggtttatatcccagtcattgtccctccccctgtgctctcaggcaatagatgattggctatttctttacctcctgttttttcctaattagcattttagtgagctctctttactacttggttggtcaggtgtgagctaagttgcaagccccatgtttaaaggtgaatgcggtcaccttcccagctaggatatccagctagtcctatctctcagtacccccctcaacaggaaaacccaactgcttttggggagattggctgatgaccactctaactgcttcctgctgaactggggtgtagcaggggtcgtgcagttgagatttcctgtggaggggtgcctttgatgtcatcaacatcagagcatgggctagcaggccagtccaggggtctgcagtagatcttagtcatggactgcaactgaggctccatttaaagaacaatttgtagttttacagcttcaattctggaagagacaaaattaacaaagaggttaaagatacagggattgaaatgtatggcctgcagtacaggggattatttctttggcacacttcacaggccctgactatgtgcttgatggttttgaaaaggccttgtccagtaaataatgatttggccatctgatgggtactatcaatgcctaagggaaaggtttggtgaagggttttaagtaatttccattggttagctgtaggcaaaagtatttttctttcttcagtggctagccatcctgaggggaggaaactgtgtcctcaagaggttccccattctatttctcctgctgagtgctggggcttggtttcctggagggaattaccctatactaggggtccttctagaagcatttctaatggagggtcctgccttgcggctcttttggcttcaatatccgcttggctgttcccttctatttctttttcctttcctttctgatgaccccggcagtgtaagactgccacctctttaggtttctgtacagccaataataatctcttaatggcttcctgatgtttgataggtgttcccttggaagttaggcattccctttctctccatattgctgcgtgggcatggaggactaggtagacatacttagagtctgtatatatatttaccctttttcgttctcctaattctagtgcctgagtgagggctattagttctgccagttgagtgctagttcctggagtgtggggattactttcaaggattccattatcactgaccactgcataccccactttttgaagtcctttttctacaaaggaacttccatcagtatacaagttgaggtagggatcagtcaagggaacctctagaaggtcccctcgagcagcgtaggtttgagcaatcacctgttgacagttatgttctatcttttcttcattgtctggaagaaatgtggctgggttaagagttgcacaagtgtgcagtcgcagcaatggcccttcaagtaatagagcctgatatttaagcaaatggttgtctgacagccacaagtctcctttggcagtgagtatgctgttttacctcatgagatgtccacacagtaaaatctcttccctgtattattttaactgcttcagatactaagactgctactgccaccactacatgtaaataatgaggccaacattttgccactacatcaatttccttactcaggtatgccatgggtttcaagctggtccgtcggacctgtgtaaggactcctggagctattcctgtttttgtgtgtgtgtgtgtgacatataaagaaaagtcttgccctgttggcaagcttaacaatggggcttgggttagggccttctttaaggcctggaaagctgcttctgcttcaggtgtccatcttactaaatgggcattggctttctgagtttccttaattagtatatataatggcctggttattttgccgtacttgggaatccatattcggcagaagcctgttatgccaaggaaccctcttagttgctttaggattttgggatgagcataagccagaatagattgcatacgttcctcactgagggtcctagtgcctttggataattttaaccctaagtatttcacctgctgtgagcagagctgagcctttggtttggaaaccttgtagccacaggtggcaaggaagtttaagagcgcttgggtggcttgatggcacaaggtttctgaacaggcggctaaaagtaaattatccacgtaccgaaggatatgagtgtccaggtatgagaactggctcaagtcttgtactcagtttttgttacctccccacctccacccgattaatgataggccaaaggctttcctgttgctaagtgtattaggtatgcagtattataa

SEQ ID NO: 9845 - DNA, 893 bp, artificial
  synthetic oligonucleotide
atgaagagggagggagagaagaagagagagagagaggaactcgcattcagagagaccaaagagagcaaggaccacagttaataggctagtggaggccaagactacatctttgcacttttgcttgcctctgcctatctgatcctcccacattaaccccgttctaccactcctctgtacttctccagatagagttcagaagttttgtcttcagctacttgtcaaaacatttgtcatttcccaaccaaaccttaagctgttttgggcccttaggaaaccagctcagggtcagatacagagaacatgctccttggacttccagttgatgtatcttagcagtctttctgtggaaactgctgcagagggatcaaagaagatcaatgattcccagcccccattcagtatctgttctagggtggatctatatggtagaaccaacatttattaactccttcaaatgtttttacttatggtctctgctctgtggactaaaggcacagctttttttttcctattctttcctccttttttctttattcattttttcaaaaatcttatctggtagccatataatttctccaaacgtagttctagctaaatacagaaggtttaactcccactcagaataccaggattcaattaaattttctgactagccattcagtggtaacctatcagcccatcttcccacgagttggagcactccaaaaaggctacaagacactcagagcttttctttaatcattccttaacccataagcaacaaaatgtaaccagggttcctgcatgtacacacacacacacacacacacacacacacacacacacacacacacacaagtgtgtatggttgaagtttgcttgcctcttttatggctgcttaatgacttctcatg

SEQ ID NO: 9846 - DNA, 513 bp, artificial
  synthetic oligonucleotide
ttacaaatcttctagtaaagtcaactctctcaaggagagtgcccttatagttcatgtacctacaatgcactggggaggacccctgaggagtactcatttcaatttcagggccactgaagtaaaagatgtctccaaagtccctctctgctttgacattttacaatctaagtcattaccttcaatgcagaagagccagtgtcctgtcctagttactgcttaaccccacggtattgtgtaagggaaaagagagcaaggatagaagggcaagccaactgaatatatccttcgaactctccaaggctctgtactcattggtataaaacaattcaaggaatagcttagcgaaaagtcagttcccactctattacaaacaagttgtgtgacctttgaatcatctgctacttctaagatcatcttagaagtaacacctccttgaatggatgaggaaattgaggcacaaagataggatggcctttgcctgaggtcacaggaggtggcaaggtttgaactaga

SEQ ID NO: 9847 - DNA, 1535 bp, artificial
  synthetic oligonucleotide
agtgattaaaaaattattgttgttgttgttattgctatctaccactgagtaaatgattttatttaataatcattgagtttcatcattgaatggtggttatttctataacccaatcaaaggcataacctctgtccagaaagactttgaaaacaaaatatgcaaattaaaaattttctttcatttcagtttattggaagtttagaaaggcctgaggcagcaggtgggtgacttgaggcactgtaaatccttcacacttaaggtgagcttcttggaggaaatgggtttgggaaaggtaaatttttatcaaggaaaaataaagtttgacagaatgagcccgcaatattaatgattgtctctcactttggacaacattttgatctctttggtgacttgtatgcattcattttcctctcattctgactctgggaaatgaggggaactgatattgcaattctatatgaatgcagtcttgagggctatggagccaagatgcctgggttcaaataccagctctgtaagttcctagctgtgagaagctacacctctctgaacctcagagagaaagaataatccctactttgcagaattctaatgaggattaaataaaatatgtatatatagggcctcaggtgttcctcaaatataatttcttgtttgcttccctgacaatatagagcataagtttgagagtcagagaagatgtgagtccaagtgaagaaaattaatttattcattcaacaaatcgcaattgagttcctcctaaatgtctagcttagtgcaaggggccagagataagagcaataaacaaagcacacaagatccttacttttgtaaagtgaacaggctaggtctttttgacatatacctgctttgctcctgtaatattttattcaaaagatcctcagtttcctcgatggaagaatagtcattgcccaacatactttatagtaaagttgtgaagattagattagataacacacagaagagttcttatggacagtatattactatactgatgaaattattagtagctgtgttcctatttgatcccaagggcaggggagctaagaggcatgggttgctagctacaggtaccagagaccatcttattatggaatcctgatcaggaatctgataagattgaaggatacgagaatgtcatcaacagcattagcccagttgctggtggtgtccaggcactttgtacagccaggaaggtgtacctctgtaatggtgaaggagaaaacctttgtcttttaagcctccagtcattccttcctgtactcaactttcctgttttccctgacaggaagcccacattttcattgccttcccaatgttctcctttttccccctctctaagtcaatatgctctaaggaaatgatctggtcaattaattcatattgatgtgccaatgactacaaaaactttataggtgaccactcctaaggaaaggggcattgaattgaaggcttagccttacaacaaacagaaaactaatggtagtattctggggaatatcaataaagctcag

SEQ ID NO: 9848 - DNA, 538 bp, artificial
  synthetic oligonucleotide
tttctctgatttctccaatgggaaatgagctctctatccttcgaacttggaatctccattctcttagcccaaaccactagcttggcttgcagttagtataatagcaacccactgctatataaataatgctttataccttatagcactatgtcgttgaagacacactggaatcctaaaggaaagcagagcagaaattaatgtctcatctaaatatgtgacagaaaagaagcattgttattttagaagttggctagagacttctatttctagcagtatgtcttactggatactgtgaatgacccacccaataaaaactattaaaatgctaagtgaaatataaaaataatcttttaaaattcattgcagtgctagtgtgatagtaaggaatccacagaggctaaaagagaaatgaaagcaggaaccctggaggtaaattagtgtcaaagccagattttgcccttagaatcttaccagaccctgggagattctgagtttctactttgatggctgtaaaatattagggaaacaggaggtaaag

SEQ ID NO: 9849 - DNA, 725 bp, artificial
  synthetic oligonucleotide
gtttgctaggtacaaaaaggaaaaaaaaaaaattggaatttgagagaaaccacgtgagcaaggtataggagatgaaagagcctacgtagcatattgaagaagctggaacaagaccagtgcagcaaatgggtaggggcatgtttaacataaggcagccactgaagaaaacatcaacaagagcaaaagtctcagaatgtaccagctgacacgaggcaattaccattttgttcattttccacaaacagctgtgctctcctcctcactcagcagtaggaatgtctctcgagagaattacagcatccagctgctacctttccctcagccactaacaaatccgccacagagaacaatgttgatctaattctacacactcataaacataaacaaagtttgagctgagcagggagaatgtcactgagcccacttctctcaaaggagtagaaaagagaaccaacactgagtggaaatctaccatgtgccaggcagtattcttagaagtgatgccatttcacactctgaaacaactctatggagtagcaattattcccttttttttttttttggagatttctaacactgtttggctcaaagagactaagtgactatccaaggtctcatggcaagagagtgacatctgatttttaatcccacactcatgctctcagaaaagactcaacttacccagctagacttcagcaactttttctccaaaaaaaaaaaacaaa

SEQ ID NO: 9850 - DNA, 1350 bp, artificial
  synthetic oligonucleotide
atcatcatctctgtatcctcagcgccaagcacagagtggtaatcagtaaggtctactgaatgaacacataggtgaaagtaaaaggcctggatataagatcctgtgacctattagcagaaggcgctagatgctaatgtgtatagctctgcactgaaaatacacatgccttggaaaatcatgttccctcagaagaaagtttctgcccttgaggagctgtgtaaaataccacatttctctctaagagaataagctgttgtttggagattgttacacaaatgtttgtctcgtaggagcacttctatgcttttattctctaaggtaatgattggaaatggaaatcaagacttgtgcctttcacaagtccctgccttcctgtggaatgctagaaactttattttctttccaccaagcttagctctttccctctgttatagtggaatgcattaattgaaagattggcatatgctcagaaaccaggaaaaaaatgatgaaatacaaacaccaagttctgtccaagtttacttttctgattcttcactattactcctgtaatggttaattttaggtgtcaacttgactggattatggaacacctagaaacctagtaaagcattatttttggatgtttctggaggagatcagggtatgagtctgagtggactaggtggggaagatccactctcaatatgagcgggcaccagccagtctgctggaggcctgcagagagcaaaaacagaaaaggcaaatgtgttgatttacccgctggagctagcatacagtcttcctcttctgtccttggacatcagaattccaggttctccagcctttgaactctagacttacaccagtgcttcctccacaacaccagggttctcaggcccttcaacctcagactgagagttacacctcagcttcccttgttctaaggccttcagatttggactgagccatgcacgttaccagcattctagggtctccagcttgcagaccttgcagacagcctgttgtgggacttctcagcctccataatttcatgagccaattctcctgataaatcccttcatatatatatatatatatatatatatatatatatatatatatggagagagagagagagagagcttaaatgagcataaaataaacaggtagagattgaaataaaaggagatgagagaggtacttttctagtgcaatgagatgtattattctcatctgaaatcacttatgatttttattggaacaaggcacccagcaaattgcctggcagagagtagatgtcaaataaatatttgtcgaatggatgaatggatatcattgaatgaaaagtagaatgtaaatagataaata

SEQ ID NO: 9851 - DNA, 236 bp, artificial
  synthetic oligonucleotide
gaaaagagcacccccttgcccttccaccctttctaccatatgaggacgtgggctagttcctccccttgggaggatgcagcaacgaggcgccatcttggaagcagagagcagccctcaccagacaccagtcttgctggcacttgatcttgtattgctcagcctccaaaactgtgagaaataaatttttattatttatacatttcccaggctgtagtattttgttatggcaacacaaa

SEQ ID NO: 9852 - DNA, 1980 bp, artificial
  synthetic oligonucleotide
gggggcaaattttatggtatataaattacattgcaataaaactgttataaagtaacaaacaggctgggtgcaatggctcatgcctgtaatcccagcattttgggaggccgaggcaggtggataacctgaggtcaggagttcgagaccagcctggccaacatggtgaaaccccatctctactgcaaatacaaaaattagccaggcttggtggtacgcgcctgtaaccccagctactcgggagtctgaggcaggagaattgcttgaacacgggaggcggaggttgcagtgagctgagattgtgccactgcattccagcctgggctacagagcaagactccatctcaaaaaaattaaaaataaaaaataaaaaaacccaccaccaaaaccaaaaatgaacaatctgaaaaacagtaacataataaaaataatggccgggtgcggtggctcacgcctgtaatcccagctctttgggaagccaaggcaggcggatcacccgagatcgggagtttgagaccagcctgaccaacatggagaaaacctgtctctactaaaaatacaaaattagccaggagagaagcatgcctgtaatcccagctactcaggaggctgaggcaggagaatcacttgaacccaggaggcagaggttgcagtgagctgagatggcaccactgcactccagcctaggcgatagagggagactccatctaaaataataataataataatagtagtagtagtagtaataataataataataataataataataataataataatttgggctctagacctcagaaagttccaagaaaaatgaacattcttaatatgtaagttgttcttacaagttaattttaaaaatcacaaaagcaaaggagacaaatacccaaagatgagactagacacaaatggctaataaatatgtgaagagatcaaaaagacagcgaataagggctatgacctccatgtcgcttgctatataaatgtctcactcatttaaccctcacaccatcctatgaagtaggctctcagcttcttgcagggaatgccgcagactactcaggactgtgtatcaccttgtcccactcatggttctctcctgacctgcagtggtggagtgtgcccccacaatgcccatctgggcaccattgactccagtggcctgacttaatccaaggggtcactgaaggtatcaagagaattcactggactgcacactttcaggcaagactcctggaaacattatttccagaagtgggagttttgctatatgctaggtggcagcacctgagcccatcttccctaatgagctcctggagtgcaaatattctgtgtggcaggctacatgcaatatgtgcacacccatcaggcttagcaattggccgggctgatagggaagttgtcagctgctgatggaagctgagttgcccagcgagggcacgcacacccctatgaggaagaccactgtgctcatgcccagcagtggaccctggaaggccctgctggcagggctgagatttcctgcaggaagctgttctgtactacaccaactggaggaaaaatgggtaatcacagtcacagactcctggaccttattgcctagctgtagcaatttcagcctggacatttttaaaagcaggtgttaccaatcatcccctttggacataaaaccccgtaataaagtgtccacggaaagtccatcctgaaacctgcaagctcgggtccttgcagaataggcttgggaacctgactgggctgcctgcttttcagggttattaactccaagccagggcctcattaaaacacgaatggtaggagcaggcaagggaaggagaggagggttggaacacctcagacccccacagtgggctcttttccttactagccagagctgactcttcacaccaacgactactaagaactgagtgactgaaagagagtctcaggtgagtggcttccatggggaggggagaaggtaag

SEQ ID NO: 9853 - DNA, 1237 bp, artificial
  synthetic oligonucleotide
tggctgtggggaggaagaatcaaggctggctctagggttggcagtggtggtcttagatgagaagaactctgggctatggccaggaatatagatgaactttccaggcctggcaacctcttgaaggacagtgagggaagagtcctggccagccccaggctgctgctgtccatgcacgacccagccttaaccaggaatgaaccaaagaagcaaagaagcaaggattggctgggaatttgagccagtatggtacaggggaatggccacaggctttggagacagatgtcccaggagtcaaatcctgctttcaccactgatcagcttggtgatctcagatgagtcacttctctctgagccttactttcccctgtaggtaaaatggggatactgaaactcatttcaaaaggttatgaaaggaaaagcatctaacttggttcttgacaatagtaggcactcagtaagcagcaggctgctttctgtattcaggttttgatgtcctagcatgcactccagggatcccagtctcccagctagactactggtgtgtccctacaccctattcatctcatctctccttccttacaccccaatgcagggtccagctgagagctcagagaccccaaacagctccttctttccctacctacccagagccacttcaccctcaagggctgcccctggaagtgggaagggcccagattttccctattttctcctctatttgggagaaaataaaaagacaaaatctgggctattcccacctctacagccacaaagatcatcagaggatccactgagaaacgcagtagctcagtcacctattaagcgagatgatggacatgaaactgtgtgaatggtggagcactttgggaatgttgctcatctaattatctccataaagaaaaagtggggagaccttgtattcttggcagtccctaagcctaccccaaactcagatatccttctagttctttcccttcctccccatacagggtgacggtttttgccaaggctacgcctgtcccaggtcttgtgctatggcaagctccgggtttatcccaggcgcccgcagtgctatggaagtccagcagggggagacattagcacgtgggtacgtcctctggggtccgaccagcgagagtgggtcggacctggaaggtctgagctatgggatcgagccaagttataagcaaagaggcaaggcggggcgggaagaatgggccagggctgggagacaaag

SEQ ID NO: 9854 - DNA, 761 bp, artificial
  synthetic oligonucleotide
gtgatatctcattgtggttgtgatttgcattcccctgatgatgagtgacattgaacaccattgtatgtacctggtggccatttgcatgtcttattctatccattctgttttgtatcttgagtttcccacatatcagtgagctgtaagcatttctccatatcattaaatattatttgcactgccccttccttcatcctaaaggcagggacctgaactgggagagcctcaaagtcctgccaggcttctgtcggtgcctggtgcatcagcagttctgccggcctggcatgggtagagatggaaacaaatccagaagagtcactggagtagtaataggagtctaaacttaggttgtggtagacaatcctagtttcaaatccagattttgccacttccaggctaccaggctctgagccaatcaatttccctagccagtcagtttccctctgaaccctggcttccccatctgtaaaatagggatagtagaatctatttcatggtccttttgtgtggcctcactaagctaatggatgtcaggacttgacccacaaggagtcccctgtgaagatcatctattattattgtgagaatgtcaggaggcccgagtaagttccttttcctctctctggcttcaatttcttcatgtgtactatgggggattgtaccggatgttgcttttcagctctgattttcttgaggtctctgtgaatagaggtagaaggaaggtgggtgctatggactgaatgtcaatgcctgcccctcca

SEQ ID NO: 9855 - DNA, 1293 bp, artificial
  synthetic oligonucleotide
ttgcttgctaggcagaaaaagaaagtggatttgtctgctgaaacctggggttccacctctgaggctaatgggtgaggagatgagaaaagaagggcagggaagagaagaggcaatgcattctggcagtttagagaaatgttagagttcttgtccagattctttgtggttctgagtgggaggtgacccaggatgtgggcctttgtggttctgcctccagctttgcatctgccaagaggccgcccttcagggacatggctttcctgccccagccaggctgtggtaagagggagggggagaggaaggaaagagggaggggacactgctcacaattcccgggaggaatctggtttctcccacaaactcttggagctcttacctcccccgcagttcccctttcccctccctcttctcagtttcctgatttctgaaggccactcactaaagccccaccagggacaagcttcctgcagcaactggatgggtaccaaggcagatggtcacatgtcaaggaaggggacacagaatcttgcccaaataacataggctttagagtgagaagcagggccaagtcataactccattacttacacactgtgtgactttaggcctagcaaggccattctctgagcctcagtttctccctctgtaaaatgggaactgacctcacagagttttagaaggattaaatgagataatgtatgtaaggcgtctaatacactacttggcacctagtagatattcaagaaatattcattttcttcctcccttacccccatcccttttaggggagagtaaacatagcttaatcctcttaccaggcttctacctgggcacagacccttctcatctcacttgctctgccatctgaggctcctccccacatcctccatgagactggcgacatccacattttaagattaaaggggccatgcatcccttcttaacttgggtgctggatttggagttggaggacttgctaatggtgtgaccctggtaattgcttaacttttctaggcctcagtttcctcatctgaaaatagggataatcatccctgctttgccagccttgcagggttgttatgagattccaatgagatcattctttgggaagtgcaaagcagtggatatgtgtgggtgttattagctcggtccaggagggagggaggggaggcttaatccctggagactgaattagcacccacctcaggggattttctcattggggacaccagggccaaagtattcagaggttcaggggtggctgggggcatagaattggagctcagccatgag

SEQ ID NO: 9856 - DNA, 1137 bp, artificial
  synthetic oligonucleotide
aggatatacattttgtgcatcaatttagcaaaaatttaaaatagtggccaaggttgcggtgagatgggcaatctcatgtactgctggtggaagtgtaaattggtatagcctttttggcaggcaatttggaaatatcaagacccttaaaaacaggtatacattgtgactcgataattacccttacaggaactgacactaaagaaatatctgcaaatttggattaaaatatatgtaaaagcaattcataaaaacagtaataagctaaatgtccaccataagaaaattaaatacatacaattatctacaatttataaggatattatggaggaaaaatttgctcatgctataacgttaagctaaaatatgaagaataccaaatcatagatacagcatgatcctgattttttgtttttactaacagtaaacgttcatataaaaagactagaaggaaattaaccaattgttaacagtgtctgactctaggtggtgggattatagtggattataataataaaagctaacacttgtatagcgcttttctcagcactttacatatatttatatacacttactccttatatctatcctacaggagaaataccatattatccccattttgcagatgaggagacagaagtggagagaggtgaagtgacttgctcaacatcacacagttggtaattttcttctttgtaattgtcattctccagattctccactatgagtatgtttgacttttataatcagaacaaaaatgcacagggataagctttgttaagaaaaattgaagggtactgtggcttacagggcctccttggcccagctggagacagctctactgagcagccagtttttatgtggcactgcaggtcttggggtctttgtgatcttctcttggcctatcctgtctggccacagcccaccgctcagggcctgcccctctcctgcttgatatgcctcatggctaatgccccacctccccacctactggcctttgtcccttgcagggaaagcctactttgctagctggacgctcacctctactgtccatccctggaatagcagaggctggcagtgggctggctttgcctaccagccccatctcagggacatcaccaagggggatgtggaggggga

SEQ ID NO: 9857 - DNA, 1233 bp, artificial
  synthetic oligonucleotide
tgaaccttcagtggggaagcaggtgatggggggtggggggcaggtggccatgtcatggaacagacaaagaaggcaaactgtggggccctacaaaggtctctgcaaagatctctgaccgaaggcagctgcaacttaacttttgctcagaatcaagcctcaattcaacgaatatgtactgagtatccacaatccacctggcatttcagaaaatgcttttctaaacaggcagttgccatcagtcaagcgcttgctatatgacaagcaggcattgtgcacaatccattgaatcttcacagatccttcgaagggtgctacgaacatggaccccattttgcaggtgggtaaagtgagagttagaaaagccaaaccgcatgcccaaagtctccaaggtagaaagtgacagatctgggaacagaatctaggcctgccagactaaaacatctatgttcttaagccctgtgttatctgtctccgaaggggagtgccctgcctgggaagcacgaatgacagccaactgcattaaaagcgggaaaacagagaaaatgcaggacaagaaagagagccctagcgaggggccagctcacttccagaggacacaggggccatgggaacatgggggtgcctcccctcaacatcctaccacagacttatcaagcctaggagccccaggtttggctgaggtggggcttgctgagtgtgtgagggctctactggcactacccattggagctgaggggcccagagcatatggatgacagtgcaaagggcccagagagaacaaaggaggtgggactggggaagggggatgttcagagaaattctggggggaaatcatgggaaaagcttccaaagcaaagaatgatgccttttgctttgtaaatcaggacgtacttgtaggacagaagcaagagaccagaggggcaagagcctggctcagcagaatgctggcagacaaaaggagtcaggcctctcaagctttgtcaggcaactgacacagactcttgacgagggtgaaacaagctctcaaatgggacctgagggatctgaaattgcatagttagaaagggggcagatttgagttgtgaacacgggcttaatctggtttcagagcctgtcttagttcaggctgtgataacaaaatacattagactgagtcatttatcaataatagaaatttattgctcacagttctgaaaagtccaggatcaaggtgccaacagacttggtgtctgg

SEQ ID NO: 9858 - DNA, 2251 bp, artificial
  synthetic oligonucleotide
agaggacactagccttccctctgttcctgaggacactgggaaaagaaaggctgaaaggctggtgtccagggccaagcctgactcgcctttggggccccagagtgcagaatgaggtctctccctcctcttgcccatccagccatccttctggaaagtgttgagcccaatgcatagtggttaagacacaggctcctttgccaggtggccagggtttgaatcgtggttgtgccacttactagttatgtggccttgggcaagttacctaagcattctaacctcattgtctcatctgtcaaatggggatgaagatggtggtaactatatcatagggttggcacaaagattaaacagattgtttgcaaagtgcttaggacagcacttgacactaaagagtaaatataatgattggctgtttgtagttttgctgtctcccagggcctgaggtgacagacaagtgttgctctgagtcttgctttggacatttccaagcaaagttattgcctttgagtgtggaggctgagaatagttgattttttttgccttgtcagagatccatagagcctgcagctgaaaaaaccccagaaaccatccagaccagccactaacatccccctacctcccacccttgctcaatgaatgagaaactgaggtccaagaaggaggcaggactggcccaatgtcacagacagtaacagcaaaggggctatgaacttgaccttttagtcacagctctagtctagcctggttgctaagtagtcaagcttggattcaaacctgggctttggcacttgagagtacttaatgactgtgtcccttaagcaagggctttaactcataggagcctcagtttcctcatctgttaaatggggatgataatatctacctcacaggcttgttgagaggatgaagtggaacaacgcatgtaagtgctcactgtggggcctggcatagagtaatgcatgtttgttaacattcttggctcaagggctctttcactgcaccagcctgcaggtgctgatgcccaggtgatgcccactgtgcaggccaggcagacccaagggctcaccaactgacaccgtgcccctctgaccaggtcattcttcccctctggtctcaggccctctgtgcctgctgttaaggcagcctgactggctcaaactggacttatcaagggccaggctggcttagacacacttgagtcgaaggacacaagtgatgccaggcagtggtgtggtggtttcattcattctccctgccctagggagaaaacacggctttctctgtatttgtttgtgtttgtttttgttttttttttagaggcagagtcttgctctgtcatccaggctggtgtgcagtgacataaacatagctcactgcagccttgaactcctgggctcaagtgatcctcctgcctcagcttcctggctaactgagactacaggcacatgccacaatgcctggctaattttttatttttaatttttgtaaagacagatgtctccctgcccaggctgttctcaaactctaggcctcaagcaatcctcctgcttcagcctcccaaatgctaggactacaggcgtgaactaccacgcatggccaactatgtgttcttttttatgctggggctggctggagacccagcttcctcagatgccctttctggggtccctttgagccagtgctggtcccctcagaggccagctcacaggccaggaggagtcagagccatttgaccaacaggcagacacagaatgcttgttccagcagttctccaccctgtatattaggctcatcatgctgggagctctgaaaatgcccatgcatgggctctatcccctagactctactttaattaacctgaactgggtctgggacacagacattgtgtagaagctccacacatgttgagtttgacagagatgcagccaggggagtgagcacctgtgcagtaggtgattccaagatgcttcagctgaggttcttggcctcacgaggctccctggctagtgggaagataagacaagtaaggaaaccatgaccagacaaaaggatgtacatactgacagggatagaaaagcatgctgctagcaccaatgtgcttttcctgggctacctcacaaaggaagtgacatttgaacttgactcatccatgcagtcaacattaagggactatttattgagcagttactgtgcatcaagatggttccaggtgttgggggtgcagcaatgccctcctgcagcttccattcta

SEQ ID NO: 9859 - DNA, 1665 bp, artificial
  synthetic oligonucleotide
gggcctgagcccaccacacagccctggctgacttggtgtggctggctgcgtggggaaggtttcaaaggacagtgccttgagaaaaggaactgagtccttgggcaccactagtgggatcgggaggcctggcacaatggggcacagcaggtggggccctgggtcatcatcagccagagctagcagggcccctcctagtctttttttttttttttttttttttgagatggaatctcgctctgttgcccaggctggagtgcagtggtgcgatctcggctcactgcaacctctgcctcacgggttcaagccattctcctgtctcagcctcccaagtagctgggaatagagacgcatgccaccacacctggctaatttttgtatttttagtagagaaggggtttcaccatattggtcaggctggtctcgaactgctgacctcaggtgatccacccgcctcagcctcccaaactgctgaggttacaggtgtgagccaccgtgcccagccccctcctagtcatctaatctaacctctcccccactctcttaggtgaggaacctgagactcagactgggaatgaattttccaagatcctgcagcccactggtgacagggctcagcctggggcatgccttgctcacccagttcaggcagcttactgcttctcctagctcccgcctctgagctgcctcaatcacagcactctcagccgctgaagtctgcagacagacgcttgggagccttgacccagtggcttctgggcctgggagagatgtgaagaaaccaggaaggatagagaacatataaagaaagaggagagatgaacttctcttgggggagcagaggaggaactaccgggtcataagtagagttgtgcatctaggagacagatgtccattccagcccttttctgccactctgatgccactgaggttgagccagttgttccttactctcaaaaagtccacagggcaaggtttgtgttccccatacaccacactgtgtgcgcccgcatgcacacacacactgatgcacatgcacagagctctaggggggatctatcctattatatgacagaggcaatggttataaagacagtctctgtccctccgtctcacagtagggcctagcattgcagttagaagggaagtactgggtggcttgggggacaaaggcccttggattccatacacccccgatggatatttttcttgttaacacacaatgctgcttgcataactggaactggctagacactgtgagaaatgtttagtacttgggaaaaagcaggaggaggaataaacagccacatagccatagggtcccagggtctgctttcccaaagatggcctgctacccctaccctcccacattcccatgaatggggtcctggaaaggaggctgcaaggagggagcaagcgctcctctcagccacatcgaatggcccactaggtatgcagggcttgtctctttgcacagaacccaaggttctctgtggcctctcatctttttgcccagctgacctagcaggaccctctggtcctggattctggtcagatccaatctctaggctgggtccaggctgggtgagcagcagttggacaactgtcagggcccaagctgaagggatgtctccacacgcctaataaggtctatgtagaaaaaccagt

SEQ ID NO: 9860 - DNA, 1515 bp, artificial
  synthetic oligonucleotide
ctcttattacagaaatgtaataagcatttctgtcattcatttcattagtatatatactataatcatccaacatattgttactattatttttgaacaagctgttattagatcagttagtaacaagaaaaacaaaatattttattttatttatgctgtcacttatttctgttttaatgttcttcctttctttacgtagattcatatttctaaccagtattatttttcttctctctgaagaacctcttttaacatttcttgcaaggcagttcctagaagtgacatcataacatgtttgccacattctatttattaaaggtgagttactaagcctaacccacactcaatgggaggagattacccaagagcatgcatgggggcaggaggaggacatcatgaggcatcatgggggcaggaggaggttggagcatttcaacctgaataaatattcccaatctgttttccaaaatggttgtaacaattcacattttcacctgaagtttattcacatctctgcttttggtgagtatttcaccagatcctcagcactcttgatataggctttaaaattgttgccaattaaaattgttgccaatctgatgagtatggaacactggctttgcttttccctgaattactagagaagttaagcatccttttacagtttttgaccatatagatctcttctctgaaatgcttgttcatatcttttgtccatgtttctactggggttgtttttatggttattgatttctaggagttctttgtatattctgaataccagatgtcagctgtatttgtaccgttgcaaatatcttctcatagtcagaattttctttaaatgtaaatatgaaattttaaaagcacttaaaataaaccatgggagaatgttttttcataatcctagaatggagaagacctttgtaagttcaatgaactatagaagagaaaaaaaaagagaaagagaaaagtttcaactacatcaaaaaaaatattctggccagcaaaaaataaacaattctaagtaaagtaaaagacaaatgcagagccaggcacagtggctcgccttgacaacttgaagccaggagttcaagaccagcttaggcaacatagcaagaccccatttcaattaaatatttgctgctaattgcataaaggactaatttcccaaatacatgaagagctcctataaatcaataaaagaccaacaaaccaattttaacatgagcaaaggataccaatatacattttattagaaaggaaatacaaatggcatttcaacatttgagaagacgttcaagctcagtgataaaaataaaatgggatgtgatttcacccatcagactgagcaatgagagacagtttgataaacactgttgttgaaggtgtggagccacaggcaggcacccttcaacattgccggtggtagggtgaggttacttggtagttagagcctctgtagtcagcaagttggcaatagctatcaaattactaatgcacatactttttggcccagaa

SEQ ID NO: 9861 - DNA, 3647 bp, artificial
  synthetic oligonucleotide
gcttgccggcaacggttgacaaaaaattacaatgtgagttactgggagtgaggaaggcaagcagaccacagggtcagtggagtccaaacaaggttagtggcgcgtcaggatgtttgtacgtccgaattcctagtgccatgtgactctgtgagggcccaagcacatggttccatccgggcggcgcagcttctctaactctcagtcagctattctcagcagcctgtagggggagccaaaaagctaggacgggggctggtgcttgggtggggggcgggcgggtggggggtggaggctgctggaaatattcctaagggcaaacaccgacaccccaccactactatcttagcccaccgccttgccccctccaggacgctctccaaactcagtcttcctcagcagctaagctgggagctgtccttcagcaccaagggccgccttgtcctcgggcaggacggtgagggcgaaggtggagttagggacactggactggtccgatccgcagccggctcgagcgtcttccagtcacggggacggcggaggcgacccagagaggcagcaagcagctacgagatgcctgctgctccttgcctccaagaatcaccctcagaagtcccctagccctcgggggagtgagggacggccatggagaggaaggcgggcgcccgggttagtgggggagggggagcgccgaggcctgggactcagcgtgtggcatgtgcacgcgggcagcgggcggatgaacggaggcgctgaagtgaatggagttgggggtggactggaaacatccccaaacagcaccggctgcggccggcgggggctggggcggggtggggtggggggagtcctgaggcgcaggcgcagtcggggcaccagtcccgctccctcctcctctccgtgcctctttctccgccctgctccccgccaaacacacttgcacaggggctctcaaggtgttctccgcacagcggaagatggcgacagactgagggtgcatggccagcgggagccacggggccgtgccgctgggctgcagccacagcggtgcgaacgagaggcggaagcgagaggcgcactaagtaaagcccggtgtctgcgtccggcgcctgtggcgctgccgggagccaggtggcccgcccgagccggaactccaggagcagcgggtgcggagccagagcggagcccgccagggactggccccggcgaacacccggagcgcgaacgaagcccgaagggcccggcaacggaccggccggccggcctaggagggcgcgagcgaggcagggagcggcgtggagcgggcagcgggcggacgggcgggagcggagcggcgcggggcgaggggagcggagcggagcgcggcggcggggcccgcacggcggcgctgaggggcgcagagctgcgccgaaccgagacggccggtttggagtgcgagccgggcggccgccggcgcggagtgaagtggcacggagccgagggcagctgaggggcccgacactatgaggagtgcggcgccgccgccgcagccgccaccgccccagtgccccgcaccgcccccagccgggacgccgggcagcgcctagcgggccgggcggcggcgcccgggctgagagcgacggagcgcgggagcggcgcggagacggcaccagagcgccccgcgactccggcctgagcggggcatcgcgccggccggcctgcctcaccatgcagcccccgaggtagagcctggacggcgccgaggagcgcagagcggcgcgcagcccgcccgccccagacggccgtctggcctcgcgcctgcctgttccctccagcccggacccccctgaaatatgttcaggggcgcttggatgtggcccgggaaagacgccgccgcgctgactatctgctgctgctgctgctgctgggctcccaggccgagcgacaaaccttgcgccgactccgagcgggcgcagcgatggcgactgtccctggcgtccctgctcttcttcaccgtgctgctcgctgaccatctgtggctgtgcgcgggggcccggccccgggccagggagctgagcagcgccatgcggcccccatggggggccggccgggagcggcagccggtgcctcctcgcgcggtgctgccgctgccgccgccgccgcccggcgagcccagcgcgcccccaggcacctgcggccccagatacagcaacctgaccaaagccgcccccgccgccggctctcggccggtctgcggcggcgtcccagagcccacggggctggacgcagcttgcaccaaattgcaatctttgcagagacttttcgaaccgactactccggccccccctctgcggccccctgactccctttcccgtgccccggccgagttcccctccgccaaaaaaaacttgctcaaaggccactttcggaacttcactctctccttttgcgacacctacacggtctgggacttgctgctgggcatggaccgccccgacagcctggactgtagcctggacaccctgatgggggacctgctggccgtggtggccagcccgggctccggggcctgggaggcgtgtagcaactgtatcgaggcgtaccagcggctggaccgacacgctcaggaaaaatatgacgagttcgacctcgtgctgcataaatacttacaggcggaagagtactcaatccggtcctgcacgaaaggctgtaaggtaaggactggcttccgcagccacagcagccgccctgggcagcggcagcggccgcagtgggaccgggagaaaaaaggaagtctccctttctacccaccccaccactcccaccgtgcccagtgcagcactaccagtgccaccctgggaccttccctagtgaagaggcctcagggattcaggtcaggtaaccacctggctaacttctattaattccgggtttgggcaccttaggcctggggcttcctggcgccctgctccctcatgagtggggaggggccgcagggccctgggctgacaatgaggtggcaggagggattgtgctccccccagcctccatcctcagccagccatgcccctctcctttcagaggctggaactgaacgtcctgggactggctggtgcagggggaaggccaaagatgggaggaagaatatttggcaaccaaaccctcaccctttggcttctgccagtgggtgagaggacgagcactcctggtggtggggcacaccacacacttgaccttatgtgacctgaggtgactggccagagccgaggcaggtcgagcccaggggctgcctgtcttctcccaaggaagtcacctgcaggctcttctcccctgacaaaggaaggagctgggaacagggaacagcgactggtgggaaggccactgaaggttagtgcattctcatacaaaactcccagtgccttcccagcaccccatggtgacagtggggggaacactggctttctagctgctggggataggtatccagaggagaggtgaggcagctgcagaccggcccgcctagggaagagctgagtgttaagaaacttcttgaccctcggcggggttgctctggacagttaggtgggtgagggctgcaaacatttgggacttgatggtactgccctgctcgcccagcctggccaggtgacctgcctttgggaggaaagagaaca

SEQ ID NO: 9862 - DNA, 467 bp, artificial
  synthetic oligonucleotide
ggatatccttgttattttgattgtgatgatggtttcacaggtgtacatagatgtacatacatatgtaaaaacttaaatatgtacaatttgttgtatgtctataaagccgtaaaaatgatctctgtggctgaaaatgaagctggttataacttaatctggagtgtgtttcaggtatcagtgggttataagagaaaggatatagataggctttgaggctggagttaaagaggcaggttaaataatagagacgggctattctttagttggcttcttgccagaacgctttttcagataaaggttctgagagactgatttaaatttagtaatggcaaaggaagatttctgttccaaggttactaattggtttttaaattgccatatgattatttttatatcttatgagtaatacatgcacatagtttttaaaaatatgaactaagtacctaaaagtttataatgcagacaat

SEQ ID NO: 9863 - DNA, 598 bp, artificial
  synthetic oligonucleotide
aaaactgattgagaggtgaagtaacttgcccaaggttacatagctattgaatattattatagaactagaattcaaacccagttctgaaaagttaacaaagttcatgctgtttccacaaccccagtatttcccaaacagtacaatacagaacattaagtcaacaagagataggtatttctttaaaaagcttctataaccaaataagtttgggaaatgctgcatttcatatcccctttttgaagagtcacatttctaagtagtatattaaaggatatgagaaatcttcaatgaagaaatctgtttttccttaaccatgtgtttcccagactcttttttgaccaaggagccccatttccaataacatccgttgatgtcacacaggaccctggtgctctctagaacacagtgtgaaaaacactgcatgatctcccattcatctttctgattatcttcagagattgttacccttaggcctggctttctccatcctaaccactaaagtgaccaaagactaagtgttgcagaatacttatttagcaaagaaacacgcttatgactttgggaacatatttggtacctatacctcatgaaactttga

SEQ ID NO: 9864 - DNA, 467 bp, artificial
  synthetic oligonucleotide
aatcactccacatcagtgtctagagattgtcgtcatcattggaagggctttgagcagggaatggcaaaatctggcctacagtttagaagccttcctctagctgtctggtagaaaatagaatgtaatggggcaaatgccaaagcagggaggtcattaagaggctattacaatggtctagggagacctggtgatgaaccagcgtggataatgcaagtaaggccaacaccccagggatggaggggcccgggcccctaacaacttcattgagcagaactgccacagtaacgcagataccttgtggtgactgagagaaagaaagacatagatctttaacttatttaagccatattttattttggatctctgttacatgcactgaacctacatcccaactaacagaaatcattctagttctaacatgttcttattgttacaactgagagtcaagaaaactggcttcttgtctt

SEQ ID NO: 9865 - DNA, 1476 bp, artificial
  synthetic oligonucleotide
gtaacatatgtcaaagtgctgagagattgttattagcaagtcacaaagatttgtataagagagatttacttttctttccctcacggaatttgagcctgactgtctacccagggcactgttcagggtggaatctcatggtctgtggaagggaaacaacttttctctgctctaatcccataacccaaggacagaataccttatgcatcccctcttggggatctctgctcaacttctcttgcttccctgacgctccccgccccctggctatatcgtgcccttgtaatcctggcccagagagagcaatctcactggccttgaaaatttcatgacaagagacattaaatagggaaaccctgtttagtgcaagaaaaaatgctttatgtcaccaggatttcatcaaaatagatgagggcctggcaagcaaacaaatgttcttccagggtgggtctcatcctagcttgtgtttagaaaataaattggagttttcctacagggctcatctggtccccaccttcacttttggggaaactgaggtgtatgatcaggtgctgttccataaggatagcaggatgtacaagttccagagctgcttccgccgtatctttggtttctactgttgtgtcttctatggacaaagcttctgtcaaggctccactgggctcctgccatactccaggcctattgtcactgtgggtgagtgccactctcagccccagtgccacctcaggtttctcaacctcaacctcagcctggccccaccaaagaagagggcagcagaggggaaggtgggagctgatctgggatgcgagagtcaggcccaaggtaggagagggaggttaaaggaagaggaggtcctaacactttcctcttctcttttccgatctctcttggcagttggggagcctctgccactgccccaaattgaaaagccaagccaggagatggtggacaaataccatgcactttatatggatgctctgcacaaactgttcgaccagcataagacccactatggctgctcagagacccaaaagctgtttttcctgtgaatgaaggtactgcatgcccaggagcacaggagtgcctgccttgaagaagagactcatctgccactaaccaaagacaggcaggagatgagggaggttatatgtggtaggggagggcatgaggaattccttctttgccttcttgccacagggtccttacaggaattctttctgaagagctgcacacagtcattcctcaaaggagggcatcctagtgcccctcatgctggggcctgatgcctggtcatcatttgagtcctctgggacacattagcagtcactgcatattcccccagcccctgggcaactatctactttctgtctctgtggatttgccaattctgaacattttatataaatggaataatacaatatgtggtcttttgtggctggcttcttagcataatatttccaaggtctatccatgctg

SEQ ID NO: 9866 - DNA, 970 bp, artificial
  synthetic oligonucleotide
aattgttctagtatgctggcaaagacatgacaaaaatggctgaccattctatccagattggattggaacaagtgaagccagaaggagcttaatggattattagaagagggaaatggccaagaaatcaaagcagttaaatattgtgtgctcagctgaagcaggtgataccccatagtatttcttggtattctttatctttaatctctgggaagaaagagcacattcagtaataacctgtttttatttttattttagattcagtgggtgcaggagcaggtttgttacaagggtatattgtatgatgctgagctttgggcttctactgatcccatcacccagatagtgaacatagtacccaataggaagtttttcagctcttgcccccctttctccatccctccctccttttagagcccccaatgtctattgtttccatctttatgtccgtgtgtacccaggttaaccttgtttttttcaaaaatgagaaacctcttttttttttagctgcaggttactttaattttataggtggttggctatgtgatagactttctcttttttgccagccacctgggttttgtaatggatggacaggtagggttgatgggaaaagaatactggtctatttttcaggagacctgaatcccacctctgtcaataactacctatgtggaaaggactgttcattagatgatctttaagcttccttccaggcctcacattctaggatattatttctagtagttgatttatgactgagactcaagaatttggccacagagcaataagccaaagggaaaaaccacttcccctctacacacaaacatggtttctagaactacgagtttttgactcatatgagaagatgaaggcagctcactgtattgtagttaaccttacaaatcaaggatgtcttgagagacaccttatagtataaggttttattttagctagctgaacagcaattaat

SEQ ID NO: 9867 - DNA, 1350 bp, artificial
  synthetic oligonucleotide
tcctcactcagccacatttcctatatgtactaaggagatgctggggggtaagtcatgtgctatcatagaaaaagtagtaacctagaagccagatagacatgggtcttgagtttgccacgggttcattgagtaaccttgagcaagtcagtctccctgggcctcagattccttacctatgcaatgcagggtctagaacagcggtccccaatctttttggtaccagggaccggtttcgtggaagacagtttttccacggactggttgtgggggtggtttggggatgaaactgttccatctcagatatcaggcattagttagagtctcataaggagtgcgcaacatgtgcagttcacaacaggattcttactcctatgagattctaatgctgccactgatctgacaggaggcagaacccaggctgtaatgcttgctcgcctgcagctcacctcctgctgtgtggctcagttcctaacaggccactgaccagtactggtccccagcctaggggttgtggaccccctggtctagaacagattatgtataaggttccttctaggactaatatcctgagtcaaagtaacagtcaaagttgtgtaaatgggttttaataacaatgcttttatatggtgttatatggtatctgaaaagttaggaggaatatatgcaaaagcaccttgtgaaggatacagtatcatgcagatattgttgttaaagcactgtaagcattttacaaatattctcatttgtcacatttggcagaaaagaggaagcaggtatttttgcctctaccttactgatgaaggaatagcctgggcacggtggctcatacctgtaatcccaatacttggggaagccaaggtgggaggatcacttgagcccagagttcaaggctgcagtgaactatgattgtgccactgcactccagcctcagtgaccgagcaagaccccatctctaaatttaaaaattaaaaaaaaaaaaagaatggagattaacttggatgaagtgacttgtccaaggtcatgccaagcattaaatataggactagagcctgagtctcctaattcctagtctggtattctttgttttttgtttttgccacagcatcacttaccaatcctggtattttttttttttggaccagatctcatccttctgaagtatgaggtacagtgtaacactgagcttggtgctagaggaattatggactctaaagcagtagttctcaagtctagccacacattggaacacccaagggagcttttaaacatggagcctaggactccacccccagatattctgatgtaattagtctgaggtaggacatggactttttgaaaagctccccagag

SEQ ID NO: 9868 - DNA, 164 bp, artificial
  synthetic oligonucleotide
attttgcagatgaggaaactggggtataaagaagtaacttacccaaagtcacaaagctagtgagcaatagagctaggacctgaacgcagagctaccatccaagcttcactctagccaactctctagagtgccagcagcagccacttctaatgccctgcagccta

SEQ ID NO: 9869 - DNA, 495 bp, artificial
  synthetic oligonucleotide
tttaggctcacttacagaatagatcatgtcttctacttattctatagtgcttggcacagattaggcatttaatatttgttgagttggaatctcagtcagggtatttttacagtatagctgtatcaaatgagtcacagctgaccttcatcttatgtttctttagtggttttttttttttgcatccatatagatgcatttgtgggaaaggtacatctacctaagaattacaaaaaaaaaaaaaaaaaccctcagaatcagtcaagcacaagctgatgaagtacagaggccacagtgccatctagtgaatatcactagtttatgtctgctggtcccaagctcatttttcgaactttatatggtaaagagaaacaatatataaccagcacatgagacataactgtcttcactttaggtcacataaatattctatgaatagtctcatctttgtgtctgttgtaagtcttacagccattctgtggtttgagagtgtggttc

SEQ ID NO: 9870 - DNA, 517 bp, artificial
  synthetic oligonucleotide
tctaaaaagtaaacaaacttcctagttttcttaagcataattcaactttttcttgaccacttgaggtcaacattaacaactattttattttattgtactattaatatatcacagtgatgcctttgggagttgttatacagtacagattgttgtattaaaaatttgaatctgttttataaaattggtagagttttttttcctccctatggtcaggctatctgtatacttccctttaaaccttttctctatttgcaaagtgctaccatcaaaatgttaagagtaggaaaaccggataaccaagtttatcaaaactgggtctaaaaataattggtaaatgcctggagggagggtgttatcagtaaaatatggctcttagagatcatctactcagatgacttcctttaaaaaattaatgactttgtttttatagaaacatgaattgtgcttataaaaattcaaacaatatggtagagtatttagaagaaagcaacacgtcacctaaaatgccaccattcag

SEQ ID NO: 9871 - DNA, 4118 bp, artificial
  synthetic oligonucleotide
tccccagattctttcatcccatttcccaacttttgcagttgctgttaccccacccctttcctctacagcatagaggaccacccagggctgaatatgaggcttcttccacaaccagttgctctgctgtggagcatgcactggggtcaggaaatgactccagggatcactgcacctcctatggtccagggctgcatgtcctcctcacattcagtttcctgctgctagtatgatctccttgcaacttaatggcagaagtggcaagaggtgggagaagccttcttagcctgcctaagggatagaggagaatttcctccctagagcaactggcaagctcctgaaaccacgaggttgcaatatgcacttggggttgggggctgggcagcaatggggtctcagacagaccctataggtcaacaacagcattggggactgctcaaggtggctcacacctgtaaacccaacactttgggaggcaaaagtgggaagatcgcttgagcccaggagttcaagaccagcctgggcaacatagcaagccccccatctctacaaaaaaaaaaaattgaaaaattagctgggcatggtgacacatacctgtggtcccagctaattgagaggctgaggtgggaggatcgctggagcccaggaggtcaaggctgcagtgagcagtgattgtgccactgcactctagccttagtgatatagccagaccttgtccccaccctctaataaaaaacaacccacagcattagggagaaaaaggagagatcttgggtttgacagaccatttattcccccaaagcaactttgttatcttttcctgagaagatttttttttttttttgagacggagtcttgctctgtcgcccggactggagtgcagtggtgcaatcttggcccactgcaacctctgcctcctgggttccagtgattctcccacccagcagctgggattacaggcatgcgccaccacacacggctaattttttgtatttttagtagagatggggtttcacattgttagccaggatggtcttgatctcctgacctcaagtgatctgcccacttcagcctcctaaagtgctgggattacaggcgtgagcaacggcgcccagcctttttttttttttttttttaatggttagcctttgctttctacagacactatctgcagaagcacagggagcctgctgtagaaagacttctgtctcagatacattgtttcatcctacctatcctaccgctttggaacggtgtgaccttgaggagttacttatctgagcttcagcttcttcatctggaaaatgggataacaggcttcctaaatgggtcgaaagaaaaaatgtatggaacaacgctcagcacagtttgtggcttcataaatgagctctctttcctgtcctctttcctctccatattccggagaggatctaagcctcagggaaaatcctggtgaccttaagcttctgacggggccatgggggagggcctcagcccagagcctctgggtcccctggggtcccctcttcacatccacctgcctgtgttttatctccctccccccgcccccccgtggccattcttctggtggggctatggggcgggtgcggcgatggaccgggcgggcacagaacaggtgggtgcaggctgggtgtccggcgctgggacacaagtgctctgtgtgtagggtgggcggaagtcagggcgtttgatctgaattctaaagggcgttgttcagagccccacaaaggtctcattgtgcagacactgggtataaagcagcatatgactccccagcaccgggcggtgatgaattgggacgcaggcgcggagcccagggaccactccccctgcacagacatgagaccataggggacctgtctgggtggcctcagggataggcgctccccaaggtaagagggctttgttgagtttgccccaggtctggagttaaggagctaggggacagggagccataggggatggctgatatcggaacaagatgggcttggcaaagaaaggggctggcgggaaaagaatgttggatgaaagcgaagaagggggatggggctcagggaggtcaagtcaagtgagtgaggaggaggagaagctggcaagggagatggggtgacgaggaaagacatgaccatccttcctttcctgctactggctcttggaagagttgagggggggtgcgcaggcagtgctatggcgcccgactttccaccccagctttctgacagcttgcttcatggctggtgttttgcaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaatgaagaggtggcttgtgtgtttgtcaagttctttctcctgcaacctctgacctcccccaggatgagctggccttggttttttactgattaagaaaggaacagggcaaaagaagtagttacttgagtagctgaagctgcaaatgaggaaatcactgtacttctgggccgcagagccagccccggagccattcctccctgttgcttttgttgttgtggttcttgtctttttcattgtctaataacagctttattgggatttagtttacatacctccttcctctgattttgaaaagattaaaaatgacaactccctctgaagagacaagaaatgattgggaaatttct

SEQ ID NO: 9872 - DNA, 248 bp, artificial
  synthetic oligonucleotide
aaagaaagaaactattgtgtggtaatcacttgcataagcttaacacatagtaggtgcttagtagcctgtgggattcagggcagcggggaggaagacatatgcatgtgcaaagattcagagtcgtgagagagtagaatgtgttcactgtgactagagcagaaaatgcatgggatggggagtggggtggttgcagtaggaggtgagactggcaaagcaggtcggggctggtcagtgaaaagtctcataga

SEQ ID NO: 9873 - DNA, 2019 bp, artificial
  synthetic oligonucleotide
ggcttgtaatactttcttgctgatgtggcaagctaccttaagtcgtttctagaacaagaggtgaagtataaataccaatgtgacaaaatgtctgaacagtagacttgaaactgcaggaagatcgtaagaaccgatttgttcaaggaagtagaggcaattcatgactcaatctagacgtgtggtttaggcagatggcaagtgaattcatttatcattgttgatctgctttgagctcagtggaatcgccgactgtgacaatgtgcagagctagctggtggaaatgaagtcacaactcgaggagagtcatggattttgacgaacgtgaatcacctttaacatttttatggctgccttcggagtgcaaacgcccagcatgtccctgagttattaaacatttgccctatcaccgtgggcaggagtattctgaataccaaaacgattttgaaatttcaggctatacggccaacattgaaggtgtctgcattcaactggccctgtgaaagcttcagtctttttcatcgaagtgctgaaatcgatggccgagtcacaatgaagacgggctcaaatcggaaccctctcgctcctcgttttgagcagctgtctttgagaggcaatcttctgaattgactggctcagaattgatccgtgagagtcgtaaccatccgtttttgtacgaatacagttgataaacttttttagacgcctttggcatttatgtttaaaacgacaccacctgctaagtaacaaacactcttcttaatcgcggtggcaaaaacgtatccgtcccgtgtgtgtttgtttttacccttccgctacactcttaagaaacttggccgcttccgccccagagagtgccctaaccacgagtcgggttgacagggctgctcgcatgcgcggtctccaccgtggtgtttgtcgcaatgggcgctgcgcggaggactacatggaatctcgactttgcagcttgaagtcattttgttggcggcgctggttaccggctacctccgcgcgggcacttgattgtaacagaaagtagttccggcccatgttgtttcggccgaggagccgtcgccgccatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacaggtaccggtgtcccgttctaccttggcagatgcccccttggggtctcgcgccgtcctctaccttgtatcactccttccctcccttccctcgaaccatccccattacatcagtgacattgctaagcttttcgtggtctactggcatctgatcacatcgggttttccgctgttgtccgcttcccgaacatttcctcctcctcccttgcttgctttttgctgcctttcttgctttgtttttatttcgtaaatgttctagcattccactctctccaggcgcttttatcacacgtgcgcgcttagaatgtcgtggaatggactgcattggaatccctgccctttcactcctttgcagcggttttctcccctaattccagctcatcgcctctcctttttcccctccatctcctccttcatctccccccccagtcttttccccttagccagatttggtccttctctgccaatctagggcgggggtgccgttccgatgtaatcatatcctcactttgcatcacccgaggacgatcaaaagctcgtcgatggtgccacaagtcacctcgagaagaggggacattgagcagcaccctgctaggcagtgcctttctggtgttctttcggttgagcggtcccggtttagattggaaatttccaggggtttcctttgccatcgcccaattccaccgctgccctcagcctggatttcccaccctg

SEQ ID NO: 9874 - DNA, 1191 bp, artificial
  synthetic oligonucleotide
tcccagtgtaaagacacattttataaaggtgtgattttggtttgaggttaaaatataatacagcatgaattatgtaattaattacaattacttgatatattttgatatagtacagcttgaatgagttgtaacaaaccatccattaagcatgagttacattttgtgtgtgtgtgtgtgtgtgtgtgtgtgtgtgtgtgtgtgtgtgtttatttacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgtaaggatttttactcattctatttgttatctggtaggattaagagtcttttctggccaggtgtggtggctcacacttgtaatgccagcacttcgggaggccgagatcagaggattgcttgagcttagggtttcgagaccagcctaggcaacatgacgaaaccctgtctctacaagaaatacaaaaattagccgggcatggtggcacacacctgtagtcccagctccttgggaggccgaggtgggaggatcgattgagtcctgggaggttgaggctgcagtgggccatgattgtgccacagcactccagcctgggcaacagagcacgagactctgtctcaaaaaaatcacaaaaaccaaaaaacagcaaaaaaggaaagtcttttgtacaagtattgagatggtatattggtttactttagagttttggttgagggtaagaataccaaaaaatatcaattttctgtagcattaccagccattaggcttaattaaacaattattagaacagtatcagtggaggctttatgattctgtacagtttttgaagactttgttttgttttctaggttgctgaagcagaagattgttataatacagctctccgtctgtgtcccacccatgcagactctctgaataacctagccaatatcaaacgagaacagggaaacattgaagaggcagttcgcttgtatcgtaaagcattagaagtatgtgagggtggtgtagctgggcatttagcatgatagtagagggaaagcagttaagtttaccatcatc

SEQ ID NO: 9875 - DNA, 3539 bp, artificial
  synthetic oligonucleotide
ttctgaggacaataatgtgccccctcttttctgccttctggaatggagagaaatcaggccgtgaccacagggttgcccgcactgaaagcacatctcggctcctgtaaccctcttcggagagcatcccagcagcccagcctggccagggatagagcctatcccagctggcggaccctaccagaaggaggcgtccctgggctctctttttgcataaactatggagtggcgtccctctatctgaattaagtctattgttccagaaaatgggtttgtttctattcatccactccaatggctttacaatgtccagccactgtgggactccctagagacattgtcttcttgaacagtcgaataagatatttggttttttggtccttatttccaagctcctgggtgctagaaggttgtattcacagcctagtctagcccgtgcgtggcaccgagtacgtttgggaaaggaaatctagatcaataaagtcaaactattcggtcggtcttcgctgattacccgctggtgtgggcgcgggtgtgcttgaatttttttttttttttttgtaattatgaagaaaaagtttaagttaaaaaaaaaagcaaaaaataactttaaccatcagaactgggagtggagctcctcaggaggaccggggcacacattctacaccgtaccttacgtcccccctcacgcagacattccttctttcacgctccagctcgctctttttactcctacttccctttctccctctcccggatcaagcgttaatctgcgaatctctgaccgcaaaagaagaaaaaaaaaaaaggtgggtggggggatcccgaagtagcagagctaggaggaggaggaggagaaaagagaggaggaggaggggggaggaggaggaggagcccggcgaagcagagtcagagggactggtggctccggcgagtgtgcagccccgggggagccggcgctctaggcgaggaacccgtcagcccgcctacccgcccgtcgtctttggcgcccgcacgctctccggcccgcgcccaggggcctgctacacccggagctggggccgccgctcaggggcgctcgggccaggggcgctgctcggggtgagcccgccgcgccgccagactggtcccctgcgcccgcgcccgcggccgggatgccgttctacaggcgcacggtggtaccccagcgcctgtgcccgcgcaacccgccgcagcagctggcggagctccgcgacgtgagccacctggcagcgctcagcctgctccggcagctcgccgacctctgtggccactcgttggctctgctcgaggacctcgaggggcacctgctggccctggggcgccgcacagacagcctgtaccggcgcaccgtgcgcctccgccgccgccttccctgccgcctgcttggcccggaggaggacgaggaagagctaggtaaaaacggcgccccggtggctcgcggccccgcgtctaccccgcctctaggggcgccggtcggcgcttagcgctgtgcccaccctctccccgcctctctccgcccctcccctcccctccattcggggagtgaggggatcccatttccccgacccccgcctccgccccacggtcgccctaccgctggaacttcctgctcttggacccggtcgcgccgtccggagtggccccgtgcccttgggactcccgaccctggggttggtggccgcctcctggggttttggctggggacgcgctgggtccaggacggcttgggcgatactccccctacccgcccacctagccccaggccctcggcgccgtcctcatcgccgcgtcgggagctaaatggccgagccgctggcttctttgctcctgtctaggagctcggccacttcagaaagcgcgccgcagccgaccgcaacctacgcggcggcaggagccggcggtggtgcctacaggctttaaacctgtgcaacttcccgctggagcgtggacgcggctcccactcacaggagtgtctgagcgtcctcccgcttgcttctctccgcacgttttgggccgctgtgctggggagtggccgggaggggggaggggagaatgtccggggctttgctgaccccctacccactaccgctagggtctggctgttatttgctggagagaatcatttaaagaaactatcatcagtttcctgaagcgcattcactttaggaatcagccatgcctgagaaaccaggttccagtggtgccctcactgagcacgcgggacgtgtgagagggtaggggggctacgcgagcccttgtcctttactgttttggatcccagcactttacacggggaatcctctgtctgtggaaatgcagtgcccctgagagtgtgggacttctgctgaaagcaaggggactgagtaggctggaaatgctgactacagctggggcatgccaggtaccagggccaatcggttcctccagaaagctggggagagaaggagcagtgtggccagaaagtttccaatgggggcagaagatgactgctggctgatttctgagtgcaagcttccagctaacttgggaaagaattgcctgggccagcccctcttcattgcagaccccaccccatccccaccccttccagaaggactggagtcaggccctggcacctctcttcataaaggtctctgacctctgaggtagatggcagaggtctctggtggagataaatgaactgagtcctattggaaaagaaaggtggaagccacagatgactgccagatggaatgtagacgttggaccaggagcctctgcatggcaggggctcagttttttgctggggtcccactgattacaggattagtctaggagaaatttgataagtcagcttgaggagtagttttcaaaatccctacacagtttgcagagagccacctactgagttcagtagggtaagttaaggacagttttttcaactctaccttcctgtccactgaattagcaagccctttctgtgggagggaaggcagggcttcaccaagtcacctttgggacctaaccctctccggtgatctgccaggttagaaggagatggctttatgcaatggatagcttgcaatggagaggaacaattgttaagttaaattaccactggtttggcttcttggcagttttcaagagcaggaagagtggccatctctcatccctggtgtggcctcttgcttttgagaatgtacatgtcccacggctcagaggcacccaagggactgctgcataaatggaacacagctaccttctgtaagttggtgaaaaggtctgattttccattttctggtctaatgccctaccctagactccccttgaagttctcagtgcacacttttctcttcaggagctgtaattgggtagcactgaaattaggccttctcagcaatggtctgaacataagtgccaaatgcaaagagagttggggagcgtaatcagtgcaccatctggccactcccttgtcgctcaggcataagcttcaacagggtgtttagcaagccgaatattagattttgaccgtaagtaagtaa

SEQ ID NO: 9876 - DNA, 707 bp, artificial
  synthetic oligonucleotide
tttaaaaaagatacgagagttaaacatagaattaccttgaaaagttaaacatagaattaccatataacctatcagttccacttctaggtatatacccaaaagaagtgaaaacagagacttgaacaggtatgttcagttgcatgaatgttcatagcactgggctgtgagagggcctgggctatgaaggaaggctgggctgggggtcatcccagcctggggggtctgacctgcagtgagacattattgacaatagctgaaaggtggaaacaacccagatgtccattggcagatgagtagagaaataaaatttgggatatccataaagtggaatattatacaaccaaaaaaaggaatgaagttctgacacatgctacaatatagtttagtcttgaagacattatgctaaccgaaagaaaccaaacacaaaagaacaaatattgtatgattccacttatatgaaacatgtagaccagaccaattcagagagacagaaagttgactagaagttaccagggcctaggagagggagaaataggaaattactacttatcagttacagtgtgtctgtttggggtgatgaaacattttggaaatccatagtggtgatggttgtacaacattgtgaataggtttcatgccattgaattgtacacttaaaagggcaaattgtgtcttacgtatattttactgcaacaaagtagttttaa

SEQ ID NO: 9877 - DNA, 1047 bp, artificial
  synthetic oligonucleotide
ctggattagagggttgtcaggaaatcggcctcatttgagtcaacaaggaaggccttgagtatgaagataaggagcatgggcatgtgttctgctcacattgaggggatgctaaaggtttctgagcaggaggttgcccaaggtgacgctgaggtctccagcctgggattcattaacagaaatacagaagtcaggaggaagagtggattaggatagcaggagaggttctattttaagtatattaaatttgagactaaaaaagtgggtatccaggtgaagatgtccaccaggctctgagaaatgcaagtgggcagactgggagagtggctgtggcaacaggaaagagttgaggatcatcctctgagatgatcttggggcgtttggagtgattgtgctcaacaaggaagaaaaggcagggagagaaaagaggccaaggcagggaattgtcataggctggcatctccaagaaacagatttggagatattgatttgcctgcaaaaggtttgttgggaactgccttctagaacagcacctgtgagggagcaggatcggtcagagacaggagttcacctgcagtgtgggcacactggagacctcagttgataacatgggaagctctggagctgagatgctcttcagatggccccagttgaggccaggcagctgggcctttcttcccccacctcccaccccaccccatctattaacgagatcttggatgcaggctgccccccaggaaaggggttgttaccttggagaagagactcaaccgtgagccatggaccaacacctctggtagctgggggactgagtgccttggtcctgaatgggggatcaagcagctcaaggtctggtgttctagtcactcaggaaatgcaactggctccctcccaccctgcaggcctctgggcaagtccctccctgcagcccaaagccaggtataggagtcccagggacagggagtcaggacctaaaaggaatttgagtccttgatgcctgtaattcagagtcctcagtctttcccccaacctctctcacttggggctaag

SEQ ID NO: 9878 - DNA, 8080 bp, artificial
  synthetic oligonucleotide
gggaggactgagcagctatgtgaggaacctggagaaggcacctcaaaccccagtttaatgatgggagtctcttgcttttgcaattttccagagaaatctgagctcccaggtcacaggatccttcttcagccctatctatctattgcacatgggcaagagggcaaaggaaaggccttaatgggtcagttggattggggctagagagtgggtgggggtggcttttacagttggtgaagtgtgtgccacgtggccaggaatgtgcctttagacttggatgtgcatgtagcaaggaggctgcacaaaggtctgatcagtctctcttccaagaaagcccccaaccagcccctgtatgccatggtgttcctggagtcttagggcaatgagaccaggtactcctgaggagatagccacagtggtgctggcagcaggaattcagtgaacagcccccttcaccctcccttctccttccatcccatccagctccttcccagctagccactcacaaccccgccatgggcctcagaattgctaaagggacatcagaccatactacacatcattagatctcaatgaagaacacctctagttggcccgtctctttgtaagtaactttatttttatttacaacagaattggtggctttattcctccatctttagggacacttggcattagcagctagatggaaagtccgcagtgaagtcaaactcattctgccccagccacagctccggaagctcattggctcggtccaaccccagttccaccaccagcgacatcagcacttcctcatccactgggtccgaatcgatgatagcagggctctgggcaccagcagaaggagagagtgattctgcccctcccgcctgggccccaaagtcccagttttgcaggggtcctgcctccccgggttggcctggagtggcagcagccatcccctgatactggctattaagtttctgcaggtgcatactagccagcaagtgaggggcggggtgcaggttgaaggatgggggtttagtgggaggggtggttgtaggagagcctattggagatcccgaggaactagtgggagccccactggccttggttccatttgaggctaccccagggtagtgcagaatggccactgctttgcgatctttcaccgcaaggttggagtaggccacggagctcatctcttggttggcatcctagaagacagagaaaagcacaccatagtaaccctgctcctggcttgtccttcaccattcagcagatttagaaggttcctacctgcacttcatttgggactagaggtggagaggtagcaagacgacccccttgaaaattaggctcccacctcaagcatccttttgctgccatggctctgagcactgaggccagagcccagttacagtgctggagcacctgccatcctaagtgggttcactgctttcagctccttccccatagcctccacctcaccatcctaaaaagggcacctcctgtccctcttctcagcctcactttagtctcttcaacagagtggttttgctcctactcaatttctctgctcccttccctgccatctttcaacacccctagtgggttcaatctgaccacaatttaggcagaagctgttctcattctccccagagatagtcctgttgtctcctctctgctcaaggacactgggtaatgcacctaggagggcctggcccatgaccccggaaaatttgtctttccctgcctcatctgtaaaatggcaaaaattacctccttcgcaggtgaggtgccacccttgacatcaagtgcaggcctcgacgttgttggcatttcagagccttggcagaagttggataaattggcgggaagtgatgctgccagctggagctgttgtgctgcaagtgaggaagaagcagtggtaagggcaaaaggcttcactgaccaacaaagcactagcaaagcccaaagcagggcaatgccacgcagctatgaggcaaggatggtgactgagttagaatcaagaccagagatcacccgagcacagggaggagatcaagctggaacttttgcctgaggcaggaaaggtgcttgattcggccaggtactgcccaggcagccacctacccatatcaccaagatgggacatactgcttcctcatgcaagtgacttcacagtcccaaggtgtatgtgtgggggtgagggtggcactgttcctggttcagaggacaggaatgtccctgagtaagcaacatattgtctcaatgggctactagcatccaggctggagagttggggcctccactgggactgggagaatgtgagaagaagtcagggcaaggaagacctagaaagctagaggctgcagcacagggaaataacaagtctctagcgcaaatgtcatggagctccaaagcatgaccttgggcatgcctgtgagaagccaggctgattagggtggtctgggggctctgaggcagctggagccagagaagctaggaatgtgtcactttcctccatgtctcaagccccctccaagacagccccagcattgggctttcctaggatgcctaccccagaaacctgagtccagccattcccatctatagtgacaagtgaggcacagagattcaatgcctttttagtcaggtagcagcggttctgggagcagaatctagcacccctatggccacatgcctcacctgaccactggctaagtcatcatacctagctggattcaaaaggcttccaaagaagtgatttcctggctcaagtgccaaaggataagggaatgaaggcaaaagaatacctccaaaccagaaaataaacaaacctctgaaaatctcaacttattttcctggaggcctgtttacaaagaagaaaaaaatgtcccatagctaggcacagtagcaccctcctgtagtctcagctactcaggaagctgaggtgggaggatcacctgagccctggagtttgataccaggctgggcaacatagcgggaccctatctctttaaaaaaaaaaagccccatatattctagctttcatgatcaattagagatgtagaatttcatatttataaatacctcttggtccaaagaatcttgaggaccttaaaaagagtctctaatctttccaaggaggctagaattctccgtgacactctccactccgcagcggtcattaagaatctgctcagacacttctagaaagtggccacttactacctctctgtatcatctttgcattgcttacttgggtggatgggggtaggggagggaaaaaatagagaaaggggtaaacatttttttaaaaacatgaggaaaaaatatcagctgttgggtcccgcatcattgcttgattgaagccctgctccttctctgaggcaaccgtagaaaaatatttcaaaagcaagtgatcaccagacaagaagtctaacacatgtcgtcttcaagagccctagcacaatcagtatcagacaattttcctgtcctaagaaaaatgtctgggggccctgtccatcttttcctgttcctatccagccttccctctcctttttgccgcttggtacccgaatgtacaaaacgaagaaaaaacaacaggagcagcagcaacaacagcaaaaccaaaagagaaacattagaaaaatcaaaagagagaacgagcaaaaaaactctctctattctgatatcagttcgtgggggaagaccattttaccgcgcctccctcttcaatctgggagctcccccagaagaggccctgtgtccattcagatcttctgccttccattactgacccaccacccaccctgaccccagcctgggtctgcgctcaataggcgctcagtaagtgttgttgaatgcgtctgaagaagcaatcgcatttccatcggcatccctggctctgcttccccggctttctgccctcctccaccaccctctagcccgttcgtgggcaaaacttggcaacgcggaaacgtcccagcccgctctccaagccgcgagctgaccactgcgaaacggctgcgacaggcggctgggaaacctagagcaacaagtgccttctcgccggctgatgcctggcggccccccggccaccagttcccagtcccgctgcccgctcttcgcttcaggccttcccttgggcgagcagccccctcccgcctagacaggggtgggaaggggagagggaaaagagaagggagaggcaggtgggggcctcatctttaacctgttgggggaccaaaagttaaaatggcaccaaccggatggttccatctcgattgctattttctcactcagaaggagaaatttaaaaatccaaacagcactgcggcttggcttggacgcgctctaaccagaccagtcagtttcgccacctgaaaactaaaggcccgttgtttgcggacagctcggctgccctcctcgccgcatcccagatggagccgcggaaccgggggcggccgggagcatcccttgcacggcgggcgcgtgcacccaggccaccggggccctgagcgtccgttcccgcaagtgctgtatcaggaactgatcttagagacaggatggacaggcaggaaggggcacggggtgtcggcctccgcggcgagtccgcactccggcgccggctgctgccactctcgcgcctgatcaacacttactgagcgcccgctgagcatccgacgcggcagcaggctgagcctaccccctagccaagccgcctgcggtcagtgctaaaaccccgctaggagaagagtgagagaggctcggagaggtgcggtaacttgcccaaggtcacagcgctagaaagtggcggagccgggattcgcagccaggtctctctgactccaagtccggtgctctgcgaagcagggactcggcgcgcggctcgccagcccgcgtttatagggagaggggtgtgcgcgtgggtgtgtgtgtgtgggcgtgtgtcgggggaggggagggctgaggtcgactgggcagtagaggcaagttgcccaaattcgctaacttccatcccgcaattccgctgaactcggcccgaaaagccccctcttgcctcaattccccgaagtaaatctgagctttgtgcagctccggagccagagcgtccagatgcggtccgggagattagcaaagtcggtggaagccaagctggagaaagcgcgggcgcagggagaaaaggtgctgccgtctccccgggagaagcgggcacccggccccgctggccggcaggggggcgcgctggcaagcgaacccgagcgctggcgggcgggcgggcgggcggcccctcgcccccagcagagcagctttccaacagaaagcaagtctccccagaaccctccggcccgcctggcggccgcccactccccatacccgctccacgggagtcctcggccccgccgcccagcccggcgcccagcccggcggcccggcttacctctgagaagccgcctgccctggagagagggaagcgcggagctcggtgagccgcaagagaggcggcggagcccccagcccctggcacgcacgccgccgccaccgctaccgcgaaccggtcgcgctcagcgcccgcggccgcgccgttggccacccgaccccggggcgcctgggaaaagcccgcaccgcgccgcgccgccgctgcaccgcacagtgccgcgccaagcagcccctgaccgagctggtgcccgcccgcccgcccgcagcttcggcgccggactccggggcggtggcggtggcggccaccgcgctcccttcccggcgctggggacccggctctcaagcccccattgccgcccggagagccctgacgcacacgcacacggcagcagactggcctcggctaggaatcccaggaaggacagaccctttttttccctttttttttctcccctcaatttccacgtctttataaccggcttagggcattattagcacatgtcctggctcgtgggcgagttggtggcaaaatctgaactggatactcacggagggcccgcgcgggtgctgtgccgtccgctgctctcttcctcctcaccgagaactgcccctcgccggcggactacaagagggcagccgggcagagcgagcttcctctcggcagctcagcggtgccccttctgcagctttgccgccgggcacatttttatagcagcggctggcgtctgtggccctttaaaggcgctcgagctggtgcagtcaccgcggatcgtgtgaaagcaaagggccggctggggaacggagtccacgcggccacgcgagtccggcagccctgtggaccggccaaggctcccggggtggggctggcgagtccgggctatgggcagccctcgcccggagccctggccagtgcccggcttctaaagctgtcgggggccagggcccgggacaccggctctccccaccgccctgcgtggacttgcccaataaattccacttagtaatttcactgaggcaaaggagagccgttagtgtctgttttctgacctaaatctagtcgggggccaaaacgggcttcaggggttttgggagagagctgtgggctcaaggagtgacctggaagagcggggcgcacacgagacgggggaatggtcattagttttctgcagggctgtcttggagcctgtctgccttttgggggggctgtactatctcattcgttgaagagctgaggctgggggctccttttcctcttaaagtcgccagattctgggcagagtcgcatggggggcctatatggcagcggtggctcttctagaagttctgagctggggttgggttcgagggtttctgttctgtggtcatccagggcaggaggctggcaggatgcgacccggagaaatgctactctcccggaccgtggggccaggtacagctcactaggctcgccgaaaagccaacagtaggcaacggggtacgaagagcttgccccagggttcgcggagattcctcctgccttcccacgatgtcaggttgttttattgtaactacataatcattcccgtctagcaagaataacgttttgcatttggagttcgtctttcttaggtagagatgttgtcttacaaatccttactggaaagaggtctgggtcttctccttcacctcaattcggattctttgtggccaagaaattcccaccttaccacttacagggaggccatcgggattacccctctgtcacccccccaccccgccccggccccgccgctctttttttgctgcctttcagcaacagcgactcagtttacactgtttataaaacatactctttaagaaaaggtcctgatgttaaaaaagggggggagggaatgtcacgaagtcattttcactatgtatgtgttctgtcttcttaattggatttgaagacctgaagttctctttttcttttctttttctttttttagtagccccaagtgccctgcatttgctcttctaacaaagttctgtttgttgacggactgaccggcttaccgacacaaagatgggaagcaaatggagagacggatcaaggcccttcctcggcatctggaggaagcttgggcgagtgtcttggtcgccaggtaaacccattctccagccctcaaggctgccttgcacagctccagtcttttcacttaccctgtcccaacacaaaccccggtagcatccacaccccacacatcttcgctgcactttctcactttgcttgccagattgtgggccctgcctagtctccctctgataaaaggcgggatctgtcggcaccctaaagccttactgcaaaccgcgtgtgaaatacactctcaagttctcttggtgtttgcctgggatgaaaaaaaatgtttctgcgaaaactaagtggtggagaatgagcgactctaggctttcgaattgcatgttactaatttgaacccctgacccaccctccccgtcagccccggcttggctcgggagcaggtctggcaacagcggcagcttctccgctgcaggctccggatccgggaggtgtggatccgccctccatctattggatggctcccaggccaattgttagaaagaggcatatgttcatctcggcttctggagtgtctccggagcagttgctcaacagcca

SEQ ID NO: 9879 - DNA, 1939 bp, artificial
  synthetic oligonucleotide
cgcttgcttaagccattagcttagcctaggagaaactgactagcctgtggagaaactgacttctctcatagttttctgccctatggtcctgccacttgttacttactggcgaggtggaaaggaaatatgatcacgtaaggcaaaagagatgttggagtggagggatttggctagaactagaaatagcttgaggcccctccagccccgaagaggaaaggaaatgggcaagcagcaatcccattcccagacaggtggagcaggggatgaaagaggccagctgaccttcaagggaaaatgctggctttgatctcactgaaggaaagagggaggtgctaacctctctccaccccttcccctttccccctcagcacttcttttgctttctgggcttcagtttatgcacttttgagggggaacatggtactgaaaagggggcaaatggaaagtatgagatggggcagagggatggaagtgaaaggtagtggctattctagggtagttggtcccttctcaaccctagagtcaatgaagaaagaaatgtaaatagctcagcttgagttcagatcagcccaagcttgagttcagttcagcccacctcaatgctcttttcttgttcatgtctctccaggtcttactcacacagtgaaagcggcatacaattagatagttggtcaaaaagatattcagaagaagccctaaggttgctgttattcctccataatcatgtttgattagaggaaaccaagcaacgaacctgaatccaccaatccttttatccttgcttcaacatttagtaagtatctactatgtgcccagctaggttagtcattggggtacaaagacaataagacacgtttcataggagggattattatagagcagtgtgatgagtggtataatattaacaatactacacgtattacaagcttattatgtgtcaggcacctaaagtgtctaagcatttttaatagattgactaacttaattctcacaaccaacccatgcagtaggtactactattgtttccatttgaagctgaggatctgaagcccaggacagtaggataacttgacagaagtcatgcagctggtatgtgtggagcggagatttgaactcacgtcattctgaagatcagcactagctatggtagcctatacactacccagaaaaagtgactgtggagtagagtctgcaaagggggtatagaggatgggagggaggcagagagtatgaaacataaggggcacatttcaggtattgaagtgaattagatatgactagggggcacggacaaggagaagaaggacacaaggctagggaggcaggcatgcatttcatgatgggccctgctaaggcatttggctttatccccgactagaaggtccgtgaaggcaggacattgttttgttccctgctgcattgccagtttccaaaacagtgtgtgcacctagtaggtggtagatatttgtgggataagtgagtagaagcttgtgggagatactgcaagcttttttttttttggggatggagtctcactctgtcgcccaggctggagttcagtgtcgtgatctcgactcactgcagcttccacctcccctcccgggttcaagtgattctcctgcctcagccacccgagtaactgggactacaggagcacaccaccatgcccagctaatttttgtatttttagtagagacggggtttcaccatgttggccaggatagtcttgattgaatgcctgacctcaggtaatctgcctgccttggcctcccagagtgctgggattagaggcacgagccaccatgcccagccttctgcaagcttttaaatgagggaatgaagagatcagctgtgcattttagagggctcagaggctacagcgtggagaaggtatcggaatttgaggagaggaatgcaagtagggacaccagttagaagg

SEQ ID NO: 9880 - DNA, 1517 bp, artificial
  synthetic oligonucleotide
aagatcagcattgccctgatatcaaaaccagacaaagacactacaagaaaagaaaacaacaggccaacatcccttatcaacatagacacaaaaaaaccttgaccaagtttcagcaaaatgaatccagcaatacataaaaaggataatataacatgaccaagcagggtttattccaggaatgcaaagtcagtttaacattaaaaaatcagtgcaatttactgtactaacaataaaggaggataccatatgatcatttcaatagatgaagaaaaacatttgacaaaatcagtactcatttgtgagaaaaaaaaaagtctcagtaaattaggaatagaagggaacttcctcaacctaaaaaagaacatttttgaaaaatcctacagctaatatcacacttcatagtgaagattaagcactttccccctgtgactggggaccagataaagatattcacacaccatttccactcagcattgcactggaggtcccaaccagtgaaaaaggtgagaaaaagaaataaaagacatgaagattatacagaaagaaaattctctttattcacagatgatgtttgcatacatggattatgctaagcaatctacaaaaaagttactagagctaataagtaaatttagcaaggttacattattcaagatcaatatgaaaagtcaattgtccttcaatattctggcaacaaactattggaaattgaaatgaaaataccatttacataggatcaaaataatgaaatacagtacttagggataaattcaataatatttgtgtaagatgtgtttactggagagtacagattataatttggaattaaagaagactcaagtaaatagaaagataaattcatggcttaaaagattaaatattgttatgatgttactcctgcacaaatcaatctatagattcagtgccatctacaggttacagtgcaagaaggctgtttttttattagtaacatatacttgtatataaattgacctaattctttttaatggctacatatgttccctaatatgaatgaggtacagtttaatcagtccataaaaagcagtctggttaagtagtgttaatattttccattagtaaacctatgtgatgatacacatatacatacacacacacacacacacaccccagccctactctatcctagataagtcacgggatctaaatagtagtactggactatagaacatttttatacataataatccatgtgattgtgctaaatttgccatgtactggtcttttcatggtaccatgacacctttgggctttccctatggtagagatatctgggccaatcatacatacaagctccattcttctcagctttcccagctgggactgcttggctggccaacctggctccccagtgctctggctgaaactaacttcctcatcactggctttatgccatcactggccttatggcatcactggctttatggtatcaccggttttatattttatgagcgctatacttgaagtcctacccttat

SEQ ID NO: 9881 - DNA, 1514 bp, artificial
  synthetic oligonucleotide
agagtggtgacattaatgatgcttttggataaaagaaaagcccaagaacaaaatcgtagagttactcccttttctttgattccatcagggtagaacacagcttctactgtgtgcctttgagatctttcactggtgcttctttacctttaatatcaggggctgaacatgttttgtggtttttttgttatttagataatcaatatcctaaaagattcatctcagggcaatgggatgccagagcaatggtgttatagtcacccttaaccgatactggtggtggggtctggtaaccctaacttgtccctctagcaagacctctgatgggttcatgctcccagaaggtttagtctcctgactttctagattgcgcaccagtctaaaccagccttgtcatcttcatgctttccaacagacactctcagcaccctctagagactccctcaatagagattaaagaatgagaaattcaaagttgaaaaaccaagaagggtaggatgcagaaggagagaagagaaaaatatttgctactaacgctttgaattctcaatgtcagcctgagaaaagttattgccagcagcaaaacccctttctaagacataaattttaaacctattgcatttgatgggattgagaggcagactgtgttaaggacccaaagtattactagtcagtcccaaatgggagccgttcaactttccataggtatgttttctctaaattctctcaatcctatctgagctcaggtactgctgactcattctgcaacaactcaacctgccaggggatgcagcatatggtaaatgcctcagtgacttctgaatatctattacaaatggttcagggatgcagggatttgggaggagggaggctgccttgcagtgagcatgatgtgtcattttgttggagaacatgggtgcctcttggacatattcagaagacatttaattttctgtaagtttctttttctgcttttagcatcaaacaagctgtactggttccatgaacttctaaaaacatgaaagaaaaaaaaacaaatccataaaataaaagacaaaccttaaactcccaaaccaaccaaccaaccaaacaaccaaccaaccagcaaacaacctcatatccctttcgctgttttaattttcgtaacgtaatttcttaacgttttaaaggggcatcttttctctcactgctgagtctattatatagaaacatagattctaacgggcattctaacacgccttgtagtaggtaattctactcatcaattacgtgtcaccttggcaacagaaagggctgcatactatttttaacatattattacttatctctcactataccttttagaagtaaaccattctcattcacacaacggaaagtgagtcatccagaattaaagtcatccagtgttttcatggcaccttaccagtggcctgaagtgaatcgtcagagctagaattagaacactaattctaattcgaatgcaatgctcttgttactaaatcccaatggtctttggc

SEQ ID NO: 9882 - DNA, 1492 bp, artificial
  synthetic oligonucleotide
ccagcaggctcgagtcacgcttctgcttgctgagcagaacagccccgagggtcctcctcgagagaacatgatgtgtagaggtcttctacaggtagctcattttatttggccatgaatggttcattgcatgccaaggtcacacatggtcctagtttgccatgagtgggaccattccggttttaaaacttaaaggcccctgtcccgggaaagctctcagtcccagggaaactggaactacttcattcatgtggacactattgtcacattactgtgcactgtttttctcacatttaacagttggaccttgtagatgaaattgtaagagtgatcctgatacctaagaagtagacatttatgagtaatcgatgtgtattgaaggctctgtatatcttcatagtgtggaggtaaatgcagcattatgtgtttgcccctgaatacatatccactaaaagcctatgattggacctcagccatcacatctgctcttggggtgtcacaccagagttctagatggacccagaattgcagagagacaaggtcaggggaaggagccgggaaagaggttaacaagaccacagatgctgcagatgggactcacacgaagatgtccttcccaccagccaggccatcgctggctttgtaaggtaatgagattagcaacattagaggtgctgaaacacagcctgagcggtcacttgtaccgtatgctgcagagaggagggttcaaatggtttcagacagccctgtgattcataggattcgtgtgcaaatcagaggtaaagagcccttagctttcatgtaaatacgtaattccctctgacgtgtacaaaaattctcctcaaaatcttgtgaatttccaggcaagtgttgtgaaatacttagaaactcctccaagaagtgagcaggtctcattgtctgtcctatctcccttttctctccttgaatctactccagttaggctttctcctacaccactccactgaaacttaggagttaattgaacatgaaccaatgaacaagtgaaagtaatgtttcttatagttgtatatgactagctatgtgattaaaatgaccaaaccggcaagttgtatttaaatgcttaataaaagctaggtttaaattgttaacttaaaaaatgaatagaaatgaagacccaagtaactacactgtcatctcccagcacaactttcattctcatataaagaaactcattttctaagtaggaaggttgttccaaactgctggaaattcccaggaagaaaggcccaggttttatggagcttccacctgtttccttgtagacgcagccaactgccaccaggtggcagaacaagatgagaaaaccgtgccccacggagtccctgagcccctgctgctgcagtttttgagtgagttttctcaggggctggaatcactcctggggaaccatcccaaggttctgccctcttaagctattccagggtgcacccagggcctggtccagggtttctga

SEQ ID NO: 9883 - DNA, 1733 bp, artificial
  synthetic oligonucleotide
gctttttagacgaaatgtgcctccaacaccctcaacacctcccagaccacctcctcggggacacagctggcctgcatgaagatcgagtccagagtaatcatcaggagccgggtctttggtgtgccctggtcgcctgtcaggccccaaaccagggcaggatcgatttttctgatcaagacataggagtgctctgctggatcaagttccttcagatagaacccaaagactaactcggggaggtcagaggctttcttgaaaatctcagggaggaagctcctgtaccttttgatgacatacttcagcatgtctgcccttttgatcgccaccgtcttccggttcttaaccagcaggtactgcaccagctcagctactttctagctcacagggcccctgggcatgcgcatcagggatgtcgggggccggaggggtactgcgggggcggggggcggcgggggcgcggggcggggcagacagttgcctaggggtttctggggtccacaaaggaactttcagaagcacctgagcaggggctccatgcctcagaagaagtgctcccagggctccggggagcacttggtgtccccgctgcaggcgcccccgtgggggtttcttgggcaaggaggagaggagcaggccaccgggcctctgagacccgcaggccctgggtgtcacctctaccgcggacgttctcacctgcggctttggctggcccaggaagcaggaactctgggaagagatgcgcgtccacgggcattcggcggccggagcgctgtgtgccaggccgagaggacagtgacgtcgccgcggctgctgcggcggctgctaagaagacccggagccccagggtcttgagtcggagaccgccgccctcagaccgggaggaggaggagaaggaggaggaggaggaggaggaggaggaggaggaggagcaggaggaggaggaggaggaggaggaggaggaggaggaggaggaggaggaggaggaggaggaggaggaagaagcgggaggggagggggctaagcctccgccgcccgggtcttcccggagctgtgggaatgggcgggcgccgccccgcagtgcctcttctggcagaaaacagtaccgcaggctacagcctgagggatgcgggggcgctgctcccagaggtggggctgctcatgtgaggcttgaaagagaccataagcctaaaagccaggcccagtgtaagcgcttaataactgttacctgttgttgtgatgaatccgatcattctggattatcttcgtatccctccttctctcctgtggagaaggctcctaagagcgtaggcatttctgtccagcggctgcctctgcagcttcctcttcagatcatctacctgaagttgctttgctcagtgcctggcctagagtaagcacttagtgagttttcctttgcgttcgtttcattattatagtgtacatcgcatctacattgcttgcaccctgtgtggtcatctagatgtggaggaaggacccgggaaacaagtgacctccatggagaactgaagatgtgtttccttttctttatgatcagtggatctggggtgcacaacatcagttctcttgcgtattctttctctcctacacagtctggaaagttattgttaattgtaatctaactttgcaaaccaccattcccataatgacatcctcttcttgcctctcttactctcatgtcactgcgcctcatcctttctctacagagcgctctc

SEQ ID NO: 9884 - DNA, 2325 bp, artificial
  synthetic oligonucleotide
atgtaagtacgtaaattgtgaccaagtaaaaaatcatcatttccatcccttccatttgaggtgattccatgaggagagaaaaaattgaaaaatgaatccttgggaaaatcttcagttacagttcggattgttccccagatccgatgtttctgtttcttcttgatggttttcaaagtgacattctttccttcattccaatctatctcacagcctgtggaatactcaatcgcagttcccctatagggatggggatcataatatgctagctttgacttcagcacataggtctttgtcaacaactcatttttgaaatattcattgggtttgaagtgaaattctagtgtgaaactgaggggctcgccaggatctgaaagcttaactttaatatctgtcaggagcttcagaataggctcatcatatttcttaatcaaaggagtgagtgtatcaacgttttttaaaacagttagccaaaaatcaggaattcccttaggatcctcctcttctttattctcttctccagtagcctcaatgtcgtcctcctcctcctcctcctcctcctcttccacagcataatcataataatagtcctcataaccatcgtcctcatccacatattcatgtaccataccctcctcattaccatacatctcttcatgacacatttcctcatcatcacagtcctcagagtctgatttatattcacattcctcttctgtaggttcatagattgcattgatgatctgacgtcttttttccagtaagggttggtacatttcagcaaactttctttcaatgtcatgaaattccctcaggaatttggattctaaattggccgctctagtttgaagctttttaagggctaacacacggtacttaactttcacaggtagactttcaacaaagtctgtatctaaaacataaccgataagtccttttggacggtctgcctctgagtcctcatcagtatcgccaccttttttcccatcttccccggacccagcagcagtatcttcaccgttttccccttcttccccaagcccagcggcagcttcttcaccgcacttcccatcgtctccaagcccagcagcggcatcttcaccgcgctccagatgttccccgagcccttccaccattatctgattaccagcctcttcttgactggattctgacagctccttgcggttctctgactcggccatttttcaaaggaccgtacacgcctaaggtggctaccacagagatcgggagaccaaacctccacaggaaaagactcaccgaaatatcagaagcggcggtggtcggacctagcagtggcgtccggactgagggaacgacgatccaggctgctcggggataaaagatggtgctgaggctttgagaaccggactgaagcagtggcgacctgggctgggtgcagagggcggcgacggctgcgttgaccgatcctgcaggagagagccggagactgcagagagctgcagtgggcagacctcctccgcaagcagctactgctgcaagaaaaaaacggtgccgcagtatgattacgcagctatcacttgcctaaaatttctaggtgcaaatagattgctgcgtcacctccttccctcccacaactatgctctaatctcatttgctgcaatgtagtgactgacaaacccagagccagtaaattattagatctatcaagttttcaactctgctcaccttcccaggctctctaacatggctgattcatccacctcctcctcgtcctctagcccatctcccgcagagttttctggaatcccattgcgttcattagttcattcatccaacttttaacagatattatacttttatgctttccagagagctcagagaaaacgtaactaaaatgtcgaacaatgagagaagacaaggcacccacccatcctaaatcaatctctttgattttagatcggggacctggggaggggagaggtggatggtggaagagctgataaacaaacgcttcaaagattaaaaacaccaggaattagcactgatggtctttaggtggcgtgtcagttatttaaatattctatattatgtttgtcggtatttttcacaagctatatgattttaggttgaaaaattctcgaaacatttcctgtgaggggaggaggaggaagtccgatggcagtgggggcgaatgagggcctgtgatgaaaaactagtatggtgtatacaactacgtgactagtaaacataccagacaattaaccacaattaaccagttgcctggcttataaataaccccagtcccaatactgactttctgcttctccttcttaatgctggctttaa

SEQ ID NO: 9885 - DNA, 2910 bp, artificial
  synthetic oligonucleotide
agcggaactttgcccggtttctgcaggtctctatctgactttgaggggagctggtcagaaatccctggaggagttcctgtccccaaaagcacaatactgacgctatggggaccagatggacagaatcaagaaagatgagacagaaaggcctgggagcttggggagtgggtgaacaagttcctgtgaaagtgaaatggcccttcatttgaatgcaaatgctatgtaaaagcctgaagccccttgacgtcagcccagccattggtggcctatctatacagggctgctagtcacctggataccctcgtaagaaacgtgggatggagtagcctgaggggtgcaaaagagcttgcggcacaactacgtactgataagtttattctctgctgcttctcaaagtcgagttggggccttacagggacttcaggatggcttagggagcgccttctacccaagacacgatgtacggaagctgtcttttggagaaagaagcaggcatgtacccgggcactctcatgagccctgggggcgacggcacagctgggacaggcggcacagggggcggtgggagtccgatgccagcctccaatttcgctgcggcaccggctttctcgcactatatggggtatcctcatatgcccagcatggatcctcactggccgtctctgggagtctggggctcaccctacagtcccccgcgagaagactggagcgtgtatcctgggccgtctagtacaatgggcacagtgccggtgaacgacgtgacctctagccccgccgctttctgctcgaccgactacagcaacttgggccctgtgggcggtggaactagcggcagcagcctaccaggccaggctggcgggtcgcttgtcccgacggacgcaggcgccgccaaggccagttcccccagcaggagccgccacagcccctatgcatggatgcgcaagacggtgcaggtgacgggtgagtaatcaattccaatgcccacacacttttccttccttcccttctccgctacttctcttggtcggcctgccctcgtacttctcaggcctctcccaagagggcttagctgaggcgacccctatatggctggctggcctattaggcatctccctcgcattcgcctgggctcaaaactcactcactgagtgcagcgattgggactaaacctaccctagaggtgattttcgcctttcgctgctccatgaagaaagcgagtgagtggacaatgggtatgttaagccacaaggatcaggatgcaaccctgtagttgcccacatgggaaaagagatgcatgagaaagctcaacgggtgaatgaagcgagagggcagctgtagtgtcccgttgttcaggcactgctgcttgactgttccatttccaaacccttacccatctgagcgggctgtctcccccctccccgcccccaaagctggtgatgctcaatttaggttcacagtgcttggctggcaacggaccctccagtttagccactaagtccccgacggcaaagcaacctcttcaccctggcctctcagggaagctccagcttccttcctacaagttggcagaggcaaattggcctaaaatccattgccatcttacaacgtcctttcttctaacccaagtgttgaggcaggcgagaaggctacagcactgacctggtacataatacggtacctaaccctcacacccgcccgacacgcaaacgaatcagctccagcactaataaatggctaaagccctcataactatcaaagcaggcgtctctcaggcgtgggggctgaatgcaggtctgcggcagcgcgagagaagtcaaagcgatcgcgatcacagcctaaccagcaagccagtgggcgactgctgggagccagggcgagggaagtggccgttccactttaatcttaaccggggctgggggaggaatgtttgttttcaactgttgttcttttattacattcttattattccaaccctcgctccctgtcattagagaaaattagtaaaaatcgactctgagtattttcatccctctggggaggaaatggcatttcaatagcatttgtccgcaatgattatgctcctgttctcagttctgcactttgtctttcctccaaaaagcaaagacaggagggtgggaagtgacccatttttaccattaggagaacttttagccaggaagaggaagttctgtgtattagaacctcactagagtagcgatcccaaggtaaaagtagagttgaaatacttggctttaaagcgtttgcaagtaaatctgcattttaaaaaaatatgagtgagtctgtcgactaagtagaatagaaaaagaggttagggtggggcactcccagagtttttattacatctaatctcggggttgtaattaacatccactcactaaaccctaacaatcagcaaaagacacaaaagctagaaaagtagttgctcgcagtctaggattatgttttgaaacacattaagaggaaagtcactggcgtgctgtttgcaatagagaacaagagaggaaatggatgagataaaagaaattatctccagccttgaattttctatttatgaggaaaaatatgacagttttatctgcttaaaggtcttccgtttacatttgcttttattagcctgagtctctctcttgggcaattctaatgccaggaaaggtttcgaaacgggctccttagtctcttgcatctttgagctaaaccctcaaacctgactttacaatggcaccgtcacaagattttctatccaatttctatgagaagtttaaaatggaatgatattggaaccatttcgatttttggcagcctattctatagatgaggcttcattaaattaaaacttcgtttcattttaatgtcttataaatgaaaataacccttttgctgtattcttat

SEQ ID NO: 9886 - DNA, 1837 bp, artificial
  synthetic oligonucleotide
tctgcacctagatttcccatctgtaatataaaatcatcatgatacatacctcatagggttgcagaggattaaatgagatatacatacagagcacttagcacagtccctgagttaataagtcctccgttaagtattacataggagaagtagtaaaaagtttcctcttaagtaaaatgctaataaaagtgcttaccctgcctcccaagattgtggcaaagttatgacgcaaggcttttaaactgtaatgctgaacaaacgtaagggattggtatataccttgagatattttggacaaagttctaaccttacttttatacaatatgctttctctcacccgcctgcagttgggttaataatgcccagcattaattaataagcaataaaatcagaagataccccgaatacaagtagctgacgctcagagagcagtattaaggcgagcacccgcagaccggacctggataactccttggagttcacctctagcggccccctccccttggagctgcgcaagcgtacactgactttgctcctctctagtgcccccgcctccagcagccgcccccccacccccccgtctgcccaacacgcaggcgcgtctcctcaaatcctgtccctacacccctcctctttctcttcatttcgttccccctcctcttgcagcacctcggcaggttcaaactcttctccgggagcgtggcggcgatcgcgaggtcacgtgatgagcatcctgctgcccaacatggcggagttcgacaccatctcggaactggaggaggaggaggaagaagaagcggcaacgtcgtcgtcgtcgccgtcgtcgtcgtcgtcggtatctgggcccgacgatgacgaggaggatgaggaggaagaggaggaagaggaggaggaggaagaagaggaggaggaggaagaggaggaggaagcgccgcccccgcctcgggtagtgagcgaggagcatctgcggagatatgctcccgaccctgtattagtgcggggtgccggccacatcactgtgtaagcgagagggggtcttgggacttgaaatgcctgagatttggcaacagaggaatgagaagtgatcgaggggcctgtggagtgggggagggttgactgattgactgaggcgtacacttaggaaaggacacctggtctaaatggggaaaccatgggtggatacgtgtgaaggaagtgaggagaatgtaaatatgatgcaccaatgccaggtaaagagtgagtataggagagggaagttaggggtttgggagccagagcgattggagtaggggtgagtctcctttcttgtatgtatgctggcaagtgaacagtctctaaactgcaggatgtaccagagggttttttgctgacaagattgatactttgtgggaaacagcaattgctgtgacatgtgacaagaactaggcttgcattcttcaaaacagaaacatgatatattttgtgaataataatagaatgttcattcacccacgtattcatccatccattcttcctatcgaatccttccttatatatcactcgattagaggttcaggatgagaggcagctatggaaagtagaaaaagaaatggattgagtcagggctcttagacgctggtcccggttttgcttcttactggccctgtgaccttggtcaggttgctttttctcatttctgcgccttgatttcttcatctctaaaatgaagggtttggagtagatggtttctaaagcttttcagttctgagataatttacctccaagggattttgtatgcccaagtatgaaatatacaggcattaaatatatatggaaattaatactttgggagctgagcata

SEQ ID NO: 9887 - DNA, 2093 bp, artificial
  synthetic oligonucleotide
tcctcatctcctcccactgaggctaattactctgtcccattgcagggccccaggctctcccacctaaggtctgccccgctcccctagccccttccccagcagccccaagggtccagtctgtgtttgatcacccaggattattagatttcaaagctgtggaatcccataatttttacgagcatatgctctcctctagggtcttttcacgtctgaaaaggcggccagcagctccctgccacttctccacagtagcagtgcaggccagctgacaaggattacaaatccctagtgtctcatagctggcgcctagatagtgtgggtgacgggtagaataagagcccttgaagcaagttcagaaattctaataagctgaaatgcagcagagactgcagaggcacaaggaaagggattagatacccaaatcctgcaggggttcaggaggctatgcttcaaagcccctttgattcctgcctttcagctctctctagcggtcaccaagcgcaaagttctatgcctggttttcaagtcatttaagcagtcttttctagagacctgctgcgtgtcagacactctgctagaatccgggaacttcaggaatgaaaggaacataagtagaaaaaaaccagaagaacacaaagagtttgtactacctaacttccaagatacccttttcttctctgggcgccagtacccagagagtaccgaccttagcgccaaaattcggtcctctctgaggcagatcaggagccaccacgcccccagtgaaatggaggcggcaggaatcccacccccaacccctcttcctctccccacgactatcctcccgggggcgagagtcgcccggaagaactacccgcgcctcggcattggtttcctgctgagccccagccggataaaattagtcgattgctcacactaacaagtgtcagagtccgcgtccagctgagtgggtggggagagcagtactgggccgggccgcattcccgcccgggcctgtcagagcagcggacagacagcacctgtcgtgggcctcctcgttccctcactcctgccagagcctgtggcccccccgcggagaccggggactacacttgggagcatctttccccaactctcgtcaccgcagagaccgcgccgagcccacctgccaaatgttaatacactggaatgccaggggaggggaaaagaaggttgcacttctactctcctttcccaccacacacccacccttcactgacctcgccacgactgggccctggcatccgggcctgggggtgctaatcgacactatttcccgccaggtccccatgcccactccacactctgggactgcctgggggtggatttggccctggcggtcgctcctggtcctgccgctggcctccggccaccttgggcggggacgcggagagtggggttggctcctcccccgccgcgggtctccatccatttccccatttgggaggggtaataacccgggagccgcgccacggaaatgcatcttcccctgctattcagacgggaatccgcccacccatgacaaccgcccttcccgcctagggaaagggggcgggaagacctagcctcgggccctgccaactgccagcaagccagacggatagacagcagctgctgcgtgtccgagctcagctcctcctcgatcccccgccctctacctccctgctcgctccaccgacaccaggggccgtagcggcgacggcgccccacccccagcgctcggtccggagccctcgaggtgatccgggctgggcctgtcgaggatcttttacaatcggcggccccctattctctcccgaccggcctcgtccctagcgtcccaagagcgggatcaggcggctgctagcgaaagacctacaggagcccagactcgaggcccgccaggatgcggagactgagggcgggttcggccgccaggaagcgctcccgcccggggcagcaatcctcctccgccctcctctgcaacctccaacccgggagggccctacggggcctcctcctccacacagtgggtcagcccagtggggctgctttctgccaaagacttggcccacccttcaagcgccccttccccc

SEQ ID NO: 9888 - DNA, 1515 bp, artificial
  synthetic oligonucleotide
tcagaaaatggaaaaaggtttgaaagaagcttctctgagcaagagtgtttcatctattcactggacagacagttatgtagcacttaactctgggccctgcacaaggccagggaaataattaataaatgacgctcagctggaggtcactcttctggtgagccgcagagataagggctcctgttatctcagtccccaaagaagaacagagtcttgcatttcttccctctggagctccccagctgacccctgaagtgccttcacctacatcctccttttaaatatgtttcaccaattctttcagtcatctcactaatgcgtgcccaccacctggctggatgtgccggcataagtcatcacagtcctaagctgcctgctacctaccacacactgtccccatgccaaaccaataccattccaactatcccatttattcaaactagatgtagacacatcaccatgttctgggaactctgaagaggtgtggtgatggggcagaagcaagtgaatatttccggcaacacagaatccaattcatggtgccattctctccacttagcactgggtatagcagttggatagcttagccttagaacctgtcctcttaatcctatttgctattctctcactgtactgtgcatcttgtcaggaagtaggggctcttgaatagagccatctctgcccctgtgtcagccaccttatctctcttcctatctacccttgacctatctttgacctttatttgactttgcaccgtcattccctcatttgagcttttgttagttccccacaataaaaggaatttatgaaagcttgtgatgtatttggagagtttggctcttggagtaccccctctctctctttcaactcagagaggttggctttcagcagccaaggagtgaggaatctggtctcacacttgaattattttctgagcagtctcctgtacttcaaagacattagcctgagtgcctgggtaaggagccaaggcactaattgagtatttgagtaaaaagactttgaggatgaggaagcttgagggccaacagatccaggatggtgctggaaaagccagagttctggtgttgtgctgcccaggtccaacagaaatctagttagatatgggtgctttgaggaggaaagtaggggtgcctgctgaatacagacatatgttcacttaggtacaggccttttggggccaagtctcactccatgataccataggagaggggtaggccttgttaccgctgagaggggaaggttaaggttgaaaataactctgggaaccactgaggaaaagtgtgaatggtataataattataccattgaattatatgaattataatagttcatcctcaaaatccaaggatctgttgaacacaaaatttattagtcaggaatcagatacttgctcagcacttatgcactgtggattgaaaataatgctttctccctgatggaatgttacaaggttccacctctgatttttccaagtctgtttagaaagataggtctgta

SEQ ID NO: 9889 - DNA, 1695 bp, artificial
  synthetic oligonucleotide
tcctcctcaagtccaaggagggacatgggagctcctgagggcagggtggggttcctcgcgggccagctgtcgtcctagggtccccggtgccacctcagttgcgggctgcttgtgaggaaggagggtatgggagcaaaaaataggaggggtcttcccgaggctcggggttgatcagtgtcggttctagagcctgcggggaaaagagggcaggagaacaggatagtttgtgcttccttttttccattttaacttttcctctaacgggcatccgggcaagaacagggttcagtagtttgggaagggagctgggggaggcagtggcggctggagtaggtaggcgagtaaaaggaggaggaagggctggggagaagagcgaggctgtagcggctgcctgttgagggaggaagaggtggggggtgtggaggagggggaggagagagagatgacatggggagaggaggaggggggttggacgtgggaggaggaggagagggctcgagggaccgtctgtcgcgggacgggctggccagctggggcgcggagcctggaggaggaggcagcggcagcggcagcagcagccctccgagcagcagcagctgcagcagcagaaacaagtaccagccacaaagcggctcctctggcccaagcagccacagtccccccgccgcgatggcgctgcaaagccaggcgagcgaggaagcaaaggggccctggcaggaggcagaccaggaacagcaggagccggtgggtagcccagagccggagtctgagccggagcctgagcccgagcccgagcccgtgccagtgcccccgcccgagccccagccggagccccagcccctaccggaccccgcacccctgccggagctggagttcgagtccgagcgggtgcacgaacccgagcccacgcctacggtagagacccgcggcaccgcgcgcggcttccagcctcccgaaggtggcttcggctgggtggtggtgttcgctgccacctggtgcaacggctccatcttcggcatccataactctgtcgggatcctctactccatgctgctagaggaggaaaaggaaaaaaatcgccaagtggagttccaagcaggtgagtggccccgcacgccccacttggcattttgggcaaggttggccgctcccgctgccaccgaccccatacctcccggtccgaggcgcccctccaacgcgcctctccgactcctccccttaccccttaccccttgccccttgcccctttccatggctctcctagggtgcgggttgcggggctttgggcagcttggactggggagactaggtgcaaggcgtcccgggggtacgaactgggacattcattgatccttggcaagcaatggacttttttttgccctgggacaaatctaaatgcacctttcaggtttaaggtacctttgcccctgtgtgctgggggaaaatatttgcaggactttttttttttttggaggtggggagaagtcatgaggagaggagagaattgagaggcggggcgggctctgagagaagcactgtaccgctgatctccgcagcagccccccggttcctttggggaaacggaggtgttttctgttaaaaacactttaggaatcctgatgactatgagcgaagagtcaaacacatggcaggcgtgcgtgtctgcaagagagaaagggagggagggagttcgag

SEQ ID NO: 9890 - DNA, 734 bp, artificial
  synthetic oligonucleotide
aaaaattaagaactcagctgtcccttttcttcattatctgggcaacccttatccctacagttattagcgaaacaaaacaacaatgctggcccagttatcagggagaagcttgttttgtctcatttgtgatattgggtcctagctgctaattttctcagcgatggcagaaaaaggtaattcaggtcggctgtggtggctcacgcctgtaatcctagcactttgggatgccaaggtggaaggattgcttgagctcaggagtttgagagcagcctgggcaaaagggcaagaccctgtcttaattttttttttaaaaaaggtcattcaaaccagattagactaaaataacacaaagagccacatcactgtttatatgaatctcacaagctgagtttcttaggaaaggaaggaaacctggaaagagaagtcaaaagcctacagcaaggcagagctgtctccagggtactgggtactcagcttccctgcacttccacctggggaaggaaaggataggtatgggaaagtcttctgctgtggtgtcatgcagtggccctagtcagatctgtcttctagccctgattttgccacttagtagtatttaagtaagagcacttcactcctaccattaagactctccaacagcttctcatctcagaatgaaattctatctcccttccttggactatacaacccttatgaactggccctgccttaacttgtactgcttccccagttca

SEQ ID NO: 9891 - DNA, 352 bp, artificial
  synthetic oligonucleotide
ccatctgagaagtaggcactgctcttccagcctctggttctagagctctgtattgtcaccccaaggcatacccacccaagcaacacatttcctccttacacacacacacgcacacacacacacacacacacacaggacattcatgtacactcaaaaaaattatggtgactttcttcttccatcatggaagcaggatgcaatataaaggactggaagttggaagatgaaaaaagctgggaattctttggaagtgctaaaataaattcagctatttaataatgaccagttaagataccatttgaaattttggggggagaatagagggactagggataccatgacaagtacaaaa

SEQ ID NO: 9892 - DNA, 3055 bp, artificial
  synthetic oligonucleotide
gcatgcatgcaatctatctagattttcggggaggtgaaatattggaaagtatttctaagagacaaaaatgtctaatcactagccaccagggctagtttcagttcctctattgtaaatacgctatttgcaaaaacaagaagctcatttttgacctcccaggttacgcagtgtggggactatgaaagacatggaggaagaaagggaaataccaccaccacacagtaaatttttgacctagtaagcaaatacgtttttgttgttactgctgggtaaaatgtatgtcttccagaaattagacactgtaataaaaatgtaccagcccaaatttaaattgctcactagacagatggttaattatattcacagccacatatttcactgggatagagtttcagacactcagccagttttatttgattagccggtttcccagttaatatgtaaaatgacagttacttaggacttttttgttcccttctaaaaatattttttcaataagtgtaaattctcctcagccataagaacgtcactgctgtaaataaaacgtttggtcatatgttacctcatgtgtaaaagatgtaagggagattcacccctccaaaacacaaatggtcgtaaggagttcagagaagaccattacagcaccttttctcaccaagcaaaatattccaggaactcctccaccaaaaacaaccaaggatatattcaaatcccgggattaaagtgctttagacatttttaaaaacagccctgccagccctacaacacaaatcatgtcttttcagataacagtctagaaaatgcaacattagaaaaaggccacatatctaaatgtagtgctgtgcacagcattcaacaatatgctgggagccaagatccagaagcaaaatatgagacccacttattccaaaatgcaaccagaagcttgataaaaatcaagagtgctgttgtcgaaatggggatgccaatttttttttaacttcgaaaaagacagaaaaccttgcgcgggtgattcggtccctcacgaatcagacagacagaagcagtcatgctgaaatcgctgaattcctcagcggaacggcgccaactcagcagcgcggtttccacactttcccggagcgggactccgctccccgcgccggctcacggccttcccgccctacagggtgtacaagacgcgagccgacgtgtgctgcggggcgcggcagagagaagcgccagaagccacacagaaaagcgtcaattcgaccgccaccgagagcgcgaaggggccacaagccaatttccgcaaaggagatgagctgggcgaggctcggtctggcctccaacttaaacctgtccgcagcctcggccgagtggcgcgtgtcctgggggcgctctgtggtcgccacggccgcccggcttcgcacctttgcggctttggtccgagcgcccggcctcggccgccgcgtgggttttcccgctctcgccgaagcgtgccatgcccatgccccattccctggccaggctctaccctgcaccagtccgaaaggaggcggcactctgccgagctgcgtgcgtgtaagcgcggcggctccggtccgctcgcttcccctccccccgcaacccccttcctacggcgcaagcacagaggcctttcctagattgcagtgcctgtcagggcgagccgggatctctcgccctagcggcctcgctccctcatacacagacacacacattcgcatacagacgtcctccgttccgttttcccttccttctcgtctagctcgacttaccccagttcattccaccccctgcggccgccaccccgagccagccggggagccggcgagaaggccaggaagctgtatggcagcgctcctactcacctcacaggccgactcccgaggcgcacgtcgctggcgggctcaggcagcaggcgctgtagctagcgcggtcgcagtcaaggctgggctgtcgccgtcgccgcagctgttcgagctgccttagccgccaccgccgctgctactgctgccgccgccgccgccgcctctgcctcagctccatacgctgggcccgccaggtggacgcgcctctctcctcgctcgctccctcaggctccgccgccgccgcgctagatggagtcagagctgtcgggctctggccctgaaactcagagcctccgcggctgcccggctgctccaagggtccgtgcttcgcttacactgtcgctcgccccggctggagctacctagcgagcgggctgcgcgctcggcgcctggagcccgctctgtgcggtggctgcggccgtccgcgagagggagagaggagggcggctgctactgtcgctatagctgttaaagctattgctaaatgctgctactgccgctaatgctactgctgtggcggcggtggtggcggcggcggctgctgctgctgctgctgatgctactggttttccttcccaggttcttcccctgcctcgtcccccctcctcccccttcctcctcctcctcctactcctcctcctccttctcttcctcctccctcttctcctccctctgccgcttttctcagagcctctgcaggcactgcctggtcccctcttctcccggagctgtctctgcccattcagaaaggtgcccagagtggggccgcctctgctgccaccatcgctgttgcccctgccattgtttcctccaacacggctgttcttgctggacgccttcccccctctacccttcttccccaccacagctctccctttccctcccgctctccttaccctctctatggtcccttccttatgtgcccccccaactctgtccgtctgtccttccctcccctcgggcgcccgggagcgcgcactgcgcggccacctgtcataaagggcgcgcaccccccttccccattcccaccccgccccccactcgcgttcctgctgcccttccagtccactacgccagtggtgcgttcttcccctggcagacacgcaaccggacaccactctcccatgccttttagggcagttgtgtgtgcggagaggggcactctgaagtttggggaagaatatttg

SEQ ID NO: 9893 - DNA, 2098 bp, artificial
  synthetic oligonucleotide
agtaagttttgtttgaaaacagccaacatgattgtttctttttaaaaggcaagaatctgactggcttcttttagttgtaccttgttatctgcctctctaataagtaatatattctcctcactcacctgcaaatgtcatgtctatcttatctggcactgtaatttcccattacctacaataggatcagatatttcataagtacttaattgatatttttgaatatctaaaaatttgcagtgttatccagccaggattatttactgatgaactgcttgattccagaagggaaaagagtgaaaaaggggtctatgaatgcaaacctttagactaatattaataactcaggtgagatgggtggaatctgggcatcatcctattaaggaggaaatttgaatgctgagtgataaggtggaggaattaacttgaacaaagtccataggtaagcctcatccttacctgtgggaaaaattggagatatgggtaaagcacaattcaggatatcacaagtcaagttctactaacacatgtgttaggaccaggaaacactgagaaggagacactgttgaagattctgtaccttaataattacaaacacaaaaacacatgctctttagagacccatatatgcctaatgactttcatagtactccctcaaaatgtgtgttttaagccttttaaccttccccaaaaaacacgaagtagcaaggattatccatttgcttggcatagtatcgccttgaccaataaaagcccagtgttgatgagcaagaacttctagactggtactccaatttttctgacccaaactttattcaacatttactgaatgataccaagtatattcagtgcaaatattgcactgggtggtgctgcacgggaatcattcagtaagacaatttcttaaggttacagtaaagcaaagagtgacacaaatacttatgtccacaagtccaaagtgtgaagggagtatacagtcaggaaagatgaatttaaactggggttggatttgggaaatataagttttgtgaagggtataggattttagttgaaccttctttgaagaacggataaatctttcaggtaagggggagtagagcactctatgcagaagtaataacttaaacaaggggtcagaggtaaaagtaaaaaaaaattgggtgatggtgataaaataatgtacatgtaagatttgtgcgttcaaatctgaaatggaagatgatactgggcactctaaattggggcttattttggaggatcttggatgccaggctgagcagtaaggattttattaagaagtgagctcaagcttagatatgtgttttaggaagataactctgatggcactggggaaatggggagggaatggactagaaaagaatggactggaaaaggaatggggaaggaatggcttgcaaatgaaaattttccatttgcaagtaatgaatgggcctggtgatttcaagtaataagagcctaaactatggaggtgcaatgagaatgaagcaaactggagatatctcaggagcaaatgtctgttcgaatgaattagcaagagtaaactaatggactttgacaaaatgttgttttttgagggattctgaagatattagtgggagactaggacaacagagtgactttaatcaagataaaaaagaaaagaaggagctgtcttgtgaattattcacatatctgacacaaaatgttgctttgggagttccagatatgttctaagttggccttcaggcgatcagtggaagaatagtagatgctagagtttaaaataaaacaggcttcacactagagtaagtcaggcacttcttaggtttcccttgaacctttcgtcttagagttgcacacagagttttttcctacaaaggtcaaatatcattttagaacagcttcttagttcaatttatgatagtaaaagtctgatgacattttaaacttgcaaaaagtaacagagagaacaagctggaaatagaattatatgaaagaacaagtaatcctgagccttatttgttcactggaggtagggaggccagaagaattaaaaggtaagaaactctacaagcaaccttacgctgagaatctattcacc

SEQ ID NO: 9894 - DNA, 1568 bp, artificial
  synthetic oligonucleotide
aattttttaaaaaaccgttcctgagtgagaggtaataatggactcaaattttaggaggcactacaaccatagctacattcataagttaaggataagtagcctatggcttccaaaatgacctgtgcacagagaacatcactgtatttttcagatctaggacagtcatatttatacaagaatttagggcggtctatgttttggaaagatagttacggttttggcctatcaagaagcacgcctgtcagcaagggagttaactggcgccacctgtttatagatagcttgctgtcattacagtgctctccgaattgctaattccaactgagtaaaatctgaaccacagataaactgtcccaaattccattactaattggggaaaataatccagtcttcctcgtctttagaaaggcaagcaggctgggaatggtgtctaccccaactcttaatatgagagaaaaactatgactccgagagcctccagcgctccaggtgtcctctgcccagaacctcctgccccgtttccctttgctgaactcaaaggttttcttcttcgccctttcctcaaattactgacgttaatttccttcacttactgctgctcccagttagccatgactttcttcttggtgctctctctgccccgaggtcaggagggcaaccttttccctacaggtccccttgcccttcaccctattcttccatgtcagtggcatctcacctggtaggctcgagcggttcccaaggcgccgagttgatgtggcctccactgcggacctgagccgctaacagagactaaaggccggatcagaatcgcggagtgccggcgcttttcgaaagcagccgccgcggccgcccagcgccaagaatgcatcgcgagcagcgccatcttgagcgaggaaagaggaaccgagagaagaggattatgggacactggcggactgaattcggctaccttaattgtctctcctcttcttgttttcccagggccccagaccggaaatggattctgtttgaagattcggatgcattcgcacagcctcttttatttgtttttccttagggccgagctttgattgttttccttacacaaccgggaatattggagtaacactgtatttttctcttttcctggagttgccagatgaaatacaggatgcctacctagttaagtttcaattttacataaacaacgaatcatctcttcgtgcgtgtgtcccaaatattgtatctgctaaatctgtcaaccccatcttgtctctcataatactctcttacctcctccaactcaatgtcacgctcccctctctccattttccctatgcatattcttatcttcactcccttctgaattaaggaaagattaaactacagacgttaatttcccctgggaggaggcttcagctgtaagatttactgcttttctgtcctgtaaggactttaactttgctgattgttctctgttgcgcaaaccttggggcagttttcctttggtctgttgctcgtgggacagtctcacacacacacacacacacacacacacagagagactacagacatctttactaatt

SEQ ID NO: 9895 - DNA, 588 bp, artificial
  synthetic oligonucleotide
gaaatattatcgagccatacaaaggaattaggtgttgatacatgctacaacatggatggaccttgcaaacattatgctaagtgaaaaaaacaaaaaataccatatatgattccatttatatgaaatggccagaataacaaatctgtaaagatagaatgttagattagtgattgcctagtgctggggaattggaatacctgctaatgtatatgaggtttctttttgaagcaataaaaatatgttctaaagttgattgtggtgatggttgcgaaactccatgaatatactaaaaactattgaatcatacactttataggtgaattatatagtatatgaattatagctaataaaactttaaaaaaaaatcatgttgtattacttgccagcttcttggatgtttggcaattcaaattcagtttcctcacccttaagtagatttaagtaaatataatactctccctaagtgaataaaatacctccttcacgaggttgctgtgaggttcaaatgaagtaattatgataaattgttttgtaaacttcaaaatgctatacaaattttttaattgttattgtgtagtatataacttt

SEQ ID NO: 9896 - DNA, 2385 bp, artificial
  synthetic oligonucleotide
tcaaaattgaatttgctggttcaaggcagggtccagtactaacttcttccagtggtaatatttactcacctggaaccaataggtattaaccagaacttcttcttatctccaaacacctgctggatattcttgatgaagccaaggttgaacccatttttctctgggccacttgtaaacactggagtgcagaaggcctctaaggcagggcaggagagttgaagaaaagaggaagaaagcaataaagaaacaaatttcagcatagtcatgattttacatttctccatgtatgtgacttggttctattatatctttttgctgtggtagcacagacctctcatttttaggtattgctaaattgcttagtaaaaaccagtttaatcacttcacacaaactaaacttgttactgcatataaagaattagaactctctttttaaaagacaggggaaacacatggtggcagaaataattaagcagccacgggggtagtatgtattttgtactgctgaatttagaatataggaacagatttaacagcactttatttgaatctaagcggcaacaacagccgaatgaccaccatctttagagctgggaagaaagtaatgacacataaagagatggtaatgacattgatttggttttgaaacatttcaaaaatgaaagtgttcatgctgaagcctgcagtgtaagaaactgagttttacttcagctaaaatgtcaattggtgagccataatcacttcaaagactgtaaggaatgggaccatgttagtgcacattatttttagacacacatttatcccattaagtaaatgatttcactgttggactctagctgcatctgactgtttctcatttgttctttgttttcagactctgttatcatgaagcttttagtggttttccacttcgtagctggtctctaagccaaatgtgctaatctaccaccctagcaactaggggctacatacatatttggttaagaaaatgggtgcaaatactttttttttaaatttattattattatactttaagttttagggtacatgtgcacaatgtgcaggttagttacatatgtatacatgtgccatgctggtgtgctgcacccactaacttgtcatctagcattaggtatatctcccaatgctatccctcccccctccccccaccccacaacaggccccagagtgtgatgttccccttcctgtgtccatgtgttctcattttaaaaaatagatacagggtcttattctgtcacccaggctggagtacagtggcacaatcttagtttaccgcagccttaaactcctggccagggtcaatcaatcttcctgtctcagcttactgaggagctgcagccacaggcacatgccaccacacccagctaatgattattattttaaaaatattttaactattattttaggttcagggtaaatgtgcaagtttgttatataggtaaatttgtgacttgagggtatggtgtttgtcacccaggtactaagcatagtacccgagtgaatttttttttctgaacccctccctcctcccatactccttcctcaagtaggccccagtgtctgttgttccattctttgtgtttacgtgtactcagtctttagctcccacttataagtgagaacatgaagtatttgattttctgttcctgagttagttcacttaggataatggcttcaagcttcatttgtgttgctgcaaaggacaggatctcgttctttgttatggctgcgtagcattccatggtgtatatgtaccacattttctttatctagtttgccattgatggacctttaggttgattccacggctttgctattgtgaatagtcacccagctaattatttttatttttatttgtagagatggggttttgttatgttgctcaggctggtctcaaactcctcagctcaagtgattctcctgccttggccttccaaagtgctaggagtgctaagaatacaggagtgagccatcatgtacggccaatagatgcaaatactttcttagctgttagcattattagcaaacaaattcccaatgtgtagtagcttttgcactaaacttttctcaaatctatcctagctaaacattcaacattcaaaacttggacactttgtcctcactcctcatgtactgatttgtacacaatgtaaatacttatttcaccatagatgaaataaaatgtactggaatccatcagtaatatagttttccacataatagcctatagactaactgacagaaaatatgttcatttattttactcattttctagagaatcatttgttcaatgtatttatctcattcccatagtacctaaacagccccttgatgattgcagatatttactgatttttttttttg

SEQ ID NO: 9897 - DNA, 928 bp, artificial
  synthetic oligonucleotide
ctagtgatgcaataaggatacacaactagattataaaggaaaaagacacaggtgaagtctagagaaatccctgtgcaagccttgtatgctctccttctctaagaggggtgacacagagtgcacatttagcccagcaatgaaaatgcagcaacttgtgtgaaatgatttctaccatggaagcacactagagactcaggacccaagatttttactggggactaatcacacaagcactccctgcctggcacatgccaaattgccggattcagcaggaaggtaggtgttcagcaaaaatcatatagcttgcacatataatctacagtgtgcctccctaataagttatctgttgactgagaatactccagaaccaaggttgaagatgtcagctaagggccaaccttgtaactaggcccttctaagaatagcagtctcaggcctgctaaattaaatctttatcgctcaccatttatctaatgtgctatagctgaaattgataatcagaatgttctcaggccagataatctttcagaatcatattcctctgctacctcctaagattgggggcctgttttaacttcaggataataggaaaagggaaagttatctataaaagaaagtctacctcacttggtatagactgagtttttctggcctctgatgctgtaagttgtgatagctacattagacctccatgaaattttgggatttttcaatgtgatatattcatgtctcagtaatggccttgatcatcaactttcttttctcacattgggtagctgcctttagccatgaccaactttttttgaaaattagtaacagagaaataatttgcctgggtaaatggttggatattcataggccaatattatgagataaaagtttttagctcctggagtgcaaaactattttctgtataactctttccttt

SEQ ID NO: 9898 - DNA, 6982 bp, artificial
  synthetic oligonucleotide
tgagaataaaatatggaaagacatgaacaatactttaccaaagaggatatacaaatggcaaatgagcatatgaaaagatgttcaaaattattcgccatttcggaaatgcaaattaaagccatgatgggatatcactacacatatatgagaataactaaaattaaaaataattgagacaacaccaaatgctagtgtggatgaggagaaactggattacacatacaatgcttttcgggttgtaaaattgtgcagccagtttggaaaacagtttggtaatttcttacaaaactaaacaaaaaactgctatatgagggggtggagccaagatggccaaataggaacatctccagtctacagctcccagtgtgagcgatgcagaagatgggcgatttctgcgtttccaactgaggtaccgggtccatctcactggggagtattgtacagtgggtgcaggaccgtgggtgcagcacaccgagcgtcagctgaagcagggtgaggcattgcctcacccgggaagcacaaggggtcagggaattccctttcctagtcaaagaaaggggtgacagatggcacctggaaaatcgggtcactcctaccctaatactgtgtttttccaatggtcttagcaaacggcacaccagtagattatatcccacacgtgggtcggagggtcctacgcccacggagcctcactcattgctagcacagcagtctgagatcaaactgcaaggcagcagcgaggctgggggaggggcgcccgccattgctgaggcttgagtaggtaaacaaagtggctaggaagctcgaagtgggtggagcccaccgcagtttcaaggaggcctgccgacctctgtagactccacctctgggggcagggcatagccaaacaaaaggcagcagaaaactctgcagacttaaatgttcctgtctgacagatttgaagagagtagtggttctcccagcatgcaactggagatctgagaactcacaggctgcctcctcaagtgggtccctgaaccctgagtagcctaactgaaaggcaccgaccagtaggggcagactgacacctcacacggccgggtactcctctgagacaaaacttccagaggaaggatcaggcagcaacatttgctgttcaccaacatccactgttctgcagcctctgctgctgataccaagggaaacagggtctggagtggacttccagcaaactccaacagacctgcagctgaggatcctgactgttaggaaaactagcaaacagaaaggacatccgcaccaaaaccccatctgtacatcaccatcatcaaagacctaaggtagataaaaccacaaagatggggaaaaaacagcagaaaaactggagactctaaaaatcagaacacctctcctcctccaaaggaatgcagctcctcaccagcaatgtaacaaagctggacagagaatgacattgatgagttcagagaagaagacttcagacgatcaaactactacgagctaaaagaggaagtttgaacccaaggcaaagaagttaaaaaccttgaaaaaaaatagaggaatggctaactagaataagcaatgcagagaaatccttaaaggaattgacggagctgaaaaaccacggcacgagaactacatgacgaatgcacaagcctcagtaactgatgtgatcaactagaagaaagggtatcagtgatggaagataaaatgaatgaaatgaagcgagagagaggtttagagaaaaaagaataaaaagaaacgaacaaagcctccaagaaatatgggactatgtgaaaagaccaaatctacgtctgattggtgtacctgaaagtgacagggagaatggaaccaagttggaaaacactctgcaggatattatccaggagaagttcctcaatctagcaaggcaggccaacattcagattcaggaaatacagagaatgtcacaaagatactcctcgagaagagcaaccccaaggcacataattgtcagattcaccaaaattgaaatgaaggaaaaaatgttaagggaagccagagagaaaggtcgggttacccacaaagggaagcccatcagactaacagcggatctctccgcagaaactctaccagctagaagacagtggggaccaatattcaacattcttaaagaaaagaattttcaacccagaatttcatatccagccaaactaagcttcataagtgaaggagaaataaagtcctttacacacaagcaaatgctgagagattttgtcaccaccaggcctgccctacaagaccccctgagggaagcactaaacatggaaaggaacaaccagtaccggccactgcaaaagcatgcgaaatggtaaagaccatcgaggctaggaggaaacttcaacaactaacgacaaaacaaccagctaccatcataatgacaggatcaaatttacacataacaatattaacattaaatgtaaatgggctaaatgctccaattcaaagacacagactggcaaattggatagagtcaagacccatcagtgttctgtattcaggaaacccatctgacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaaatccttagagacctacgaagagacttagactcccacacaataataatgggagactttaacaccccactgtcaatattagacagatcaatgagacagaaagttaacaaggatatccaggaactgaactcagctctgcaccaagcggacctaatagacatctgcagagctccccaccccaaatcaacagaatatacattcttttcagcaccacaccacacctattccaaaattgaccacatagttggaagtaaagctctcctcagcaaatgtaaaagaacagaaattataacaaactatctctcagaccacagtgcaatcaaactagaactcaggattaagaaactcactcaaagccgctcaactacatggaaactgaacaacctgctcctgaatgacaactgggtatataacgaaatgaaggcagaaataaggatgttttttgaaaccaaagagaacaaaggcgcaacataccagaatctctgggacacattcaaagcagtgtgtagagggaaatttgtagcactaaatgcccacaagagaaaccaggaaagatctaaaattgacaacctaacatcacaattaaaagaactagagaagcaagagcaaataccttcgaaagctagcagaaggcaagaaataactaagatcagagcagaactgaaggaaatagagacacaaaaatcccttcaaaaaatcaatgaatccaggagctggttttttgaaaagatcaacaaaattgacaaaccgctagcaagactaataaagaagaaaagagagaagaatcaagtagccacaaaaagaaatgataaaggggatatcaccactgatcccacagaagtacaaactaccatcagagaatactataaacacctctatgcaaataaactagaaaatctagaagaaatggataaattccttgacacatacaccctcccaagactaagccaggaagaagttgaatctctgaatagaccaataagaggccctgaatttggggcaatacttaatagcttaccaaccgaaaattccaggaccagatggattcacagccgaattctaccagaggtacaaagaggaactggtaccattccttctgaaactattccaatcaatagaaagaaagggaatcctccctaactcattttatgaggccagcatcatcctgataccaaagctgggcagagacacaacaaaagagaattttagaccaatatccctgatgaacatcgttgcaaaaatcctcaataaaatactggaaaaccaaatccagcagcacatcaaaaagcttatccaccatgatcaagtggacttcatccctgggatgcaagggtggttcaacatacacaaatcaataaatgtaatccagcatataaacagaaccaaagacaaaaaccacatgattatctcaatacatgcagaaaaggcttttgacaaaattcaacatcccttcatgctaaaaactctcaataaattaggtattgatgggaaatatctcaaaataataagagctatctataacaaacccacagccattatcatactgaatgggcaaaaactggaagcattccctttgaaaactggcacaagacagggatgccctctctcaccactcctattcaacatagtgttggaagttctggccagggcaatcaggcaggagaaggaaataaagtgtattcaattaggaaaagaggaagtcaaattgtccctgtttgcagatgacatgattgcatatctataaaaccctatcgtctcagcccaaaatctccttaagctgataggcaacttagcaaagtctcaggatacaaaatcaatgtgcaaaaatcacaagcattcttacacatcaataacagtcaaacagagagccaaatcatgagtgaactcccattcacaattgcttcaaagataataaaatacttaggaatccaacttacaagtgatgtgaaggacctcttcaaggaaaactacacaccactgctcaatgaaatcaaagaggatacaaagaaatggaagaacattccatgctcatgggtaggaagagtcaatatcatgaaaatggccatactgctcaaggtaatttatagattcaatgtcatccccatcaagctaccaatgactttcttcacagaattggaaaaaactactttaaagttcatatggaaccaaaaacgagcctgcattgccaagtcaatcctaagccaaaagaacaaatctggaggcatcacactccctgacttcaaactatactacaaggctacagtaaccaaaacagcatggtactggtaccaaaacagagatatagaccaatagaagagaacagagccctcagaaataatgccacatatctacaactatctgatctttgacaaacctgagaaaaacaagaaatggggaaaggattccctatttaataaatggtgctgggaaaactggctagccacatgtagaaagctgaaattggatcccttccttacaccctatacaaaaattaattcaagatggattaaagaattaaaagttagacctaaaaccataaaaaccctagaagaaaacctaggcaataccattcaggacatgggcatgggtaaggacttcatgactaaaacaccaaaagcaatggcaacaaaagccaaaattgacaaatgggatctaattaaattaaagagcttctgcacagcaaaagaaactaccatcagagtgaacaagcaacctacagaatgggagaaaatttttgcagtctagtcatctgacaaagggctaatatccagaatctacagtgaactgaaacaaatttacaagaaaaaaacaaacaaccccatcaaaaagtgggcaaagaatatgaacagacacttctcaaaagaagacatttatgcagccaaaagacacatgaaaaaatgctcatcgtcactggccatcagagaaatgcaaatcaaaacccgaatgagacaccatcgcacacgagttagagtggtggtcattaaaaagtcaggaaacaacaggtgctggagaggatgtgaagaaataggaacacttttacactattggtgggactgttaaccagttcaaccattgtggaagtcagtgtggcgattcctcagggatctagaactagaaataccatttgacccagccattcctttactgggtatatacctaaggtattataaaacatgctgctataaagtcacatgcacacatatgtttattgcagcgctattcacaatagcaaagacttgaaaccaagccaaatgtccaacagtgatagactggattaagaaaatgtggcacatatacaccatggaatattatgcagccataaaaaaggatgagttcatgtcctttgtaggaacatggatgacgctggaaaccatcattctcagcctattatcacaagcgcaaaaaagcaaacaccacatgttctcactcatatgtgggaattgaacagtgagatcacatgcacacaggaaggggaacatcacacaccgaggcctgttgtggggttgggggagggggtagggatagcattaggtgatatacctaatgttaaatgaagagttaatgggtgcagcacaccaacatggcatatgtatacatatgtaacaaacctgcacattgtgcacatgtaccctataacttaaaagtttaataaaaaactgctatatgatctagtaattatatttttagggatttatcacagagaaatgaaaacatgtttacacaaagtcctgtgcatgaatgtttgtagcaactttacttgtcataactccaaatgggaaacaacctagttgtccttcaaaatgcaaatggttcaacaaactgttgaaccgttccatacaatggaatgaaaaggaacaaacacaggacaagcagcaacctggaggaatcttcagagaattatgctgagtgaaatgaggcggtcccaaagattacacgatgtgtgattccgtttatattacatttctgaaatgacaaaattatggaattggagaaacgattagttctttccagaggttaagaaaggggtgggagcaggaaggaagtgagtatagctgtagaagagcaacaggcaggatccctgtggcgatggaatattctgtatctcactattaatgtgaatttcctggttgtgatattgtactgtagttttgcaaaattttaccattgggggaaactgaataaagtgtacacag

SEQ ID NO: 9899 - DNA, 323 bp, artificial
  synthetic oligonucleotide
ccatggccaatactccatgaggctgttattactgccatttaaaaatatgaaatctgagatctgaatggattaagacacttccatatgatcacagagatataacatagtgggcctgagattcaaaactagatctgtttgatttcaaaattaatggtctttccacagcatcaaaatagggctcagcatagcttatgagaaacagcacaaaatacttctgtagttacttgatcaatccttatgtctagcccaaagcttatctgaacaatttgatattggactacatgagaggtactgtggtatattagaggagctcctgaactaca

SEQ ID NO: 9900 - DNA, 1020 bp, artificial
  synthetic oligonucleotide
caatattttatggcttccactagccactgtatattaattacctgttcatgggtccgtctacccctctagagtatgggatgctcaatgtcagaaagtgtaacatattgaatttaatacacccaacacacactatgcagtatgtctcaacaaagtttacattactggactattgaattgaatctcttcaatatgatgagaccctatttaaactaatatggagatataagtgtttattattataacatccattatacttaattgatttcaacaaatatttgattagaacaaactacacacaaggcacaaagctaggtactagttatccagctataactaagacagagtttgccttgaacactggctctcactcctggctgcacattgaaatcacttagaaaagcatttcttaaatactaatgtctaagcccccaccccaggaattattgtttaactcatctgggatacaggctgacattaaaatttttagtgttcagcctagactgagaatcactagtcttatggtggaaataggcatgacacaaggaaatataatgagtattttgaaagaggaggaatgctacaggaatttattatctagtcttgggagtgttgaattctatatccagcaaaaatatccttccagaaagaagtggaaatggaaacatcctcaggtgaagaaaaataaataatttgtcttcagtagagctaccctaaaagaagggtgaaaagaagttctctaaatagaaagaaaatgatgagaaaaagaaagaaatcttggagccttaagaaagaaaaagagacatcaagagggtaagcactctgtctcctcaggagtttttaaaattacatttgatggttgaaacataattgtagctctctctgagtggttctcaatgtatgcagaaaaaatatttaagacagttacaaacaagggagggtgaccccagggtacttatgccataaaaataagaatttatttctacaaaaatacctacacatgattgttcatatcagctttat

SEQ ID NO: 9901 - DNA, 610 bp, artificial
  synthetic oligonucleotide
gagcaagggggtagttctgggagctggactctaagccttgaatgaaagcaggtggagctgagacaggggtgggagctctcgcctaggaggccgggaccgtggctgcagcgcgggccgagcctcgaaggcagcagggctgtggcagctgatttcctggaacaggatcctgcatgggccgtgggcatgtgaggcggtcggccggcacacaaatcgcttttggcccgtgggtaccaggcagctgtggcctccgcctgccttggggtcgctctgtccagggtaggagacaatccaggcagcctggcacgaattgggaatctaggaaaacctcgcggtgtccaccgtgtaagggcacaagtcctggggcagcttttgccggaaactacctctggactccttgcctcagtgaggaaaccgtcctgggcccactcccagtcccagaaacagttgtctcttgggcccaaagcaggaaacgttcaacctccatccaggattgtctgtttgcctgccactatacaaactgttcaacacagctgcctgtctcacatatagaactaattacacaattaatataagccttgatctgagacaaagatcattaggtttctaagca

SEQ ID NO: 9902 - DNA, 1121 bp, artificial
  synthetic oligonucleotide
ttaccacatgtcccgtgtggggattcttatgggcatatggtggtcctcttatatggttccacatttgaccagatgtcatagcaagcacaaaacactaggaaacaaaaaaataataaaatattcatggtcaaactgttcttgtcttgattagataacaggaatatgaaaatgtgcatctgtttagttaagacatagaattttttgcagataaatgatttattaaggcttatatttcatcccaaggatcacaattcgataatacttcaaaaggaaaacactattttttttttttgacatggagtctcgctcttttgcccagactagagtgtagtggcgcgatctcggctcactgcaacctccgcctcccaggtttaagcaattctcctgcctcagcttcctgagtagctgggactatagaagcatggaaccacgcccagctaattttgtatttttagtagagacagggtttcaccatattggccaggttgatcttggtctcttgacctcgtcatctgcccacctcggcctcccaaagatatgggattataggtgtgagccactgcgcctggccaggaaaacactatttaaaaattataactatgcagacacaagtttcaaaattgaatactgaaaaggctttttagaataaaattttcaggctgggcatggtggctcatacctgtaaccccagcactttgggaggctgaggtgggcgggtcacctgaggtcaggagttcaagaccagcctggccaacatggtgaaaccccgtctctcctaaaaatacaaaaaaattagctgggcgtggtggcacacgcctgtaatcccagctactcgagaggctgaggcaggagaatcatttgagcccaggaagcagaggttgcagtgagccaagatggtgccactgcactccagtctgggtgacagaccaagactccgcctcaaagaaaaaaaaaaaagaataatattttcagaacaactagagattttcatagagatgacagtctgtcatttaggttgaataaaaggcaggtacaatcagttccttgaagttctggccatccttatgagataatgaatgaaacaaactgattttaagacagaaaattaaaatatataaaac

SEQ ID NO: 9903 - DNA, 966 bp, artificial
  synthetic oligonucleotide
cactgttttagtatgggttttctggtttcgcttttgtcgtgggggcggggtgggatagtggactcgtaccctaacaaagacccactcgaggctgcgtgtcggcccgggggcagcagggggcaggagaagctggctctagaccacgcgttccttttcacgtgaccagtcgctctctttcccgtggcggccctgcttccggcaggggcatcacccggaagtgggggtagtcgagggagggaggggtaaaggcggctggccgccgcggcggggggtgggaaaagagaagcagagggaggagttgttgctgccgccgccgcagccgcagctactgtgacttctccgattgtgtgagctttgttggagcctgcgtacgtggatttatcgctgccacggtctgcgtagctccagaggtttaaccataggatagagaaaccaggtaagtcctacattggcttcccgtcgtcctttctcctggagggggtcttctgtgctgtcagtttgtactacgagtgtggtgagaaggtcatgttagtctggggcagtctcgaaagtttcacttattcacaattcaggtattaactacatttatgttttacctcccctaacaggggatagaggaggggaaattaaatcctgacctgtgtcactttcttgtaccctcttggagagaatgtcctgatcatccatggcctacgttacccaattaattgagggtacaagaaagtttgtgtttggcattgaaagtcacatggactggggtctttgcttagtgacacctctttatactttggaagctaaggttactaaaatgaccataattgatgaaataataattgaaaaatagatatttggcttcttgtcttgctctgggagcgtaaggtaaactgagagaactcttgtttccacttagttttgttcattgtgccccctttccagtaaagttactgtccattgtccgaccctgtg

SEQ ID NO: 9904 - DNA, 1676 bp, artificial
  synthetic oligonucleotide
tattattggtcaattatactgaaaatacaaatttataattttctatactgtggaagagtcttgcttttatgacagataaatagtttctaaatgcatcaaaatttcattaaggggaggtagtagaaaatgagaattgatgattcttgattaggaatacactaacatgctagattaagtctaaaagcaaatagcaaacttttcttaacctaccattatctgtgtgcttactggctcccaaactgacttattttatttggaggaaccctgattggctggtgtagtcaatacttaggggaactggggaaaatttttttatcatggatgaatgtaaatatagcacttgaggttgtttatgatgtaaaaacagatagcttttagttctaattgagccattaatagtaaaacaacaacagaaaacatttctgaatgattaagacttctgtaataaagttaaaattgtcttgtaacaaattttcctaatgtattttaaatgtaatacagtcctttgtattttataatgcattgtaaaaatataaatatttttgtttttaaaacagtgtacaatctagtccagatttagttacaatttcttttaaaataatcatttgttagacatatggtatcatagtttctctctaggtttcaaaataatcagaatactggaaagcagaaccactgaattcagtaggtggaacttacaaacccatttgtttcctcttgaaaacagccttttttgtcgctaagtagaaaaatgttcctggctaaagattttattaaaatgtatgaatctttggctctgtgtaaacttagtctacaccagatgtgtctgagttactaaatagatcatgcaattttcttctattcatttatagttgagagagctttatttttacagtctctggccagaactggccattttctagttgtacggtgtgtttcaagaaaattttttagcctctctgagtcaattttctcattcataaacatggacagtaacacctaccttgtctaaattataggatgttgaaaggttcaggtgggataacaaatgtgaaactaccttgtgaaaattttactctccactggtttaccttcagtaattactacatatttattttccatattgaaggaaaatgtcactacattagagaaactccactgaaccctcaaaatggggatttgaaaatgtatcttacatttctggcttaaattacaaaggcacaggaggtttgcggagtgtgtctcctctgtattttgccacgttgagccctagcagaagcactgagcaatatttgttgacagactgatcatattatcagatttctggctaagaaataaagcagaaagaattcatactagcacccaaacttaaagcaggcaaggcagataacttatccccaaactcctgggaatttgctaaaatttaccatcagcaacattttactacatactgttctggtcttagtactgaatactgagtctccttacctgctaacttcaaggtccacagtttactgtccttttgcgtttgttctcagaagcaagctccaagtcttcagtaaattcgatctaccagtccttgcaattaatccttgttggcgagctgcacagtatcttgataccctgtagggtcgtaaaagcacagtccattcacagagtgcctgctctataggcaa

SEQ ID NO: 9905 - DNA, 3043 bp, artificial
  synthetic oligonucleotide
aatgttatgtgagagataaagataaagtcctccaaaggtagaaaacttgtggatgtggtggggtgtggtagagaggagtgaggggtgaaattttggaaagcttaatagaagaggtggcttttgagttgagcttttgaatttgaatttgagagaagggtaagatttgatcatcccagtatgagggtgaatttagaatggatgaagaaaaaaaagcaactctgctgctgtaaagatacctgaaaatgtggaagcgactttggaactgtgtaacaggcagaggttggaatagtttagaaggctcagaagaagataggaaaatgtaggaatgtttggaatttcctagagacttggagggctcagaagacaggaagatttgggaaagtttggaacttcctagagacttgctgaatggctttgaccaaaatgctgacagtgatatggacactaaagtccaggctgtggtggtcttagatggagatgaggaactttttgggaactaaaggtgacgcttgttatgttttagaaaacaaactggtggaattttgcccctgccctagagatctgtgaaactttgaacttgagagagagaatttagggtgtctggtagaagaaatttctaagcggcaaagcattcaagaggaagtagagcataaaagtttggaaaatttgcagcctggtgatgcaatagaaaagaaaaaccaatttttctgggaagaaattcaagcctgctgcataaatttgcataagtaacaaggagctgaatgttaatcaccaagacaatagggaaaatatctccaggacatgttagaggcctttgctaaaggccctcctatcacaggcctcaaggcctagaaggaaaacatggttttgtgggctgggccagggcccctctgttgtatgcagcctaaggatctggtgtcctgcttcccagcttctctagccctggctaaaagggaccaaggtacagctcaggctgtggctttggagggtgcaagccctgatcttggcagcttccacatggtgttgagcctgtggatacacagaagtcaagaatagaggtttgggaacctctgcttagatttcagaagatgtgtagaaacatgtgaatgtccaggcaaaagtttgctgtaggggcagagacttcatgaagaacctctgctaaggcaatgtggaaaggaaataagaggtgggagcccccacacagagtctccactgggggactgcctagtggagctgggagaagagggccaccatccctcagaccacacaatggtagatccaccaacagttttcatggtacacctggaaaagccacagaccctcaacaccaagccatgaaagcaaccaggaggggagctgtgccatgcaaagtcacaggggtggagctacccaaggctgtgggagcccacctcttgcatcaatgtgccctggatttgaaacatggagtcaaaggagatcattttggaactttatggtttcatgactgccttattggatttcagacttgtatggggcctctagcccctttgttttggccaatttctcccatttggagtgggtgtatctacccgatgcctgtacccccactgtatctagaaagtaactaacttggctttgattttatgggctcgcaggtggaaggaacttgccttctctcagatgagactttggactatggacttttgagttaatactgaaatgattaaagactttgggggactgttaggaactcatgattggttttgaaatgtaaggacatgatatttgagaggggctggggtggaatgatgcagtttggctgtctccccacccaaatcttattttgaattatagctcccataactcccccatgtcgtgggatggacctgggcagagataattgaatcatgggggtgagtctttccagtgctgttctcatgatagtgaataagtctcatgagatctgatggttttatagtggggagttcccctgcacaagttctctcttctctgccaccatgtaagatgtgactttgctccttcttgctttctgccatgattgtgaggcctccccagccatgtggaactgtgagtcaattaaacctcttttctttataaattatccagtctctggaatgtctttattagcagcatcagaacagactaatacaatctccaatgaaagaaatcatgagaacaaaagcaaagagattaggaacttcagcttgtgaatgggggaagcaacagttcagtttggataaaacctagggtacgtgaaggaaatgtgtaagttcatagacataaaatgtaatacagagctactcaaagagaaagttgagttttagcagaaagatgacaataaaaagcaaatattttatatgttcatggtcaagaaatatgtgattctggcaatttctaactgctctaaatattttattaatttactaagatcctagcatccattaatactccctcacacccaggaacacctggtagatttttaatatgatctatcaggtgatcttctcttttaatgtttcctagagcttttgaatgtatgttttcttaacactgtaatcctggctgtgatttccctcatgttcagaatgattaaattttccttcacctttgagtcaggtattaaacaggcatagatgtcccatgctaaccccagcatggacctcttggtttagctcttttatctcaatctcttcctgtagaatatttacataaccaaattccatttccccctttccttccactccatttctgaattattttgttcttgtcactaccctgtttgattttttagcagaactggattatctaaaactgcattctttgtgtgtacccctgacagaaagagaggccccttcttagtttctgattatttcttggctgaaagactgaagcagaaaatatcattagtgaggagtcacatcagattcctgggacatttgtatgttctttatgggtgccagcagagctgactctatcagcatgtgcaaaagggaaggattacactgatgaattatttgtcaaaaagtgaaaaggcattttggtt

SEQ ID NO: 9906 - DNA, 1052 bp, artificial
  synthetic oligonucleotide
tttctactatgtgcaaaacttatgctaaatgaagaacacaaagattaataaaataagagctcttgtcttagaaccttacaaattaatggaggggagggggagacaggacaactgaataaaatctcaaaagcaacatttagagggctgtttcagaaaatatcaaaagagatatgataaggcagttaatataaaagctaaataaaacatacagatgtcagcttagtggttgcaagaatgcagactggggtgatcaatgaaagatctatgaaagaggtgaaatttgaatttggcatttaacaaacaatttatattttgagggtacacacacatgcatgttcacacgtacacatgtatacacacatagacacaaagatgcatgctattatatagctgcccaatagaccattcataaataatttactgccagttccttaaaatacatgcgagcataattaaggttattttgacttaacctattgtaatagaacaaattgacatttatttttcaatttataccagtgaacatttcaaatatgttacaataaattcagatatttgcattatgtaaacaatgttaagtgaaaataattagattatttttgcaacaagatgcaatgctaattaatggagttttcacggggcctcatccactttttggattggggaagcagctcctttacttaaccctgtcagtctcctagagttaccttccatagctctttctgtctcctgacacactgcatttcatctttatttcctgtggctttatagaattcgtgaactcaaaggccatcaattatctcctaatcaacagccctaatggtcaaacctaagcaaatcaggaaccttcttcagcgtttaacaaacacagctggttgacctccctttcttgaaagtatttggttgatttggggtcaatagtgtgtacctcaatctttccaatgactccttcatctttttcttcctcacacttaaatataggtaattcaccaaactaattcttcaccccctgtgctttctcttgtgaaggctcaaggctttaattattcccc

SEQ ID NO: 9907 - DNA, 2347 bp, artificial
  synthetic oligonucleotide
gaggaagaaacagaaagagagagagagagagaaacaaaacaactggttcaagattactcaactgaagctggcattagaacgcaagtctctttcaaaggattccttcaaaagttatcattctaaataaaaatcatcgtgttaaaaggattagcttgaagcaaatttgcgtaggtggaaaatatttcattggatgccttccctctgtctttcctgccttatccttccctttgcagaatcctttgctaacccttatgatctggcatctcaggtaatcctaccatgttacccacctaaggctgtccccctctatgttcctttaattcattctaccaagtaaaatgtattctttgtatttcatttcttccactttctaaaggaaaatctagcttagctgattgattacagttaataggctaatatgtaaccccttcttgtagtattttcactttatcagtagattcctggacacatagtttcttaaaggattgaatccataatgggacatttctggcaaggtgacaagcttgggcaagtgatcattaggtaaagcagagcagaggaagctggggtatggtttttagtgtccctaaatcaccatacataagaaactatctacaagcattttaagggtacatgtaaggcagctttgtgtagaaattaatttgtctcctagcatgagctgtgctgacaaccactggccagctggatctccctccatatgtatttaataatcaatgaaacagttatggtcatgccaactatttagaaaagatcactaattgagaaaaagacaacttttacccttcaactgtattgtgagtttaacaagaggctgtgggatttttctaacatagttcaccatagttaagggctccttgtgaccagggagtgacacatgaacttttccaccgacattcctaccttctctcactctttccgaaagctgccatgtcaaaaagagatgtcagatgctaaagagattctcactcactctacttcgctaccactaatgactaagtgtaactctctatactctccttttcctgtggtaattgatttttgggatctcagcatccacttgctgaaatttcccagccatctctgagcatcttctccatgctgcacctgaccactgcttttctatgtttttcaaggcatgaatgaattaatcgtgccagattctccaacacttcctcaggagaccctattgctctgatcaagaagttccatcagcaccgaagaaaacagcaggtagtcaaatacagtcttgacttctatttctgcatctttcctaaaaataatactgttttaccctgtgggccctgtacagacaattagagcgtttgctacccacctgttgcacatttgctggtctacttgatagattaccaagcaatagcctggttttagcaatcaagatatacaatcttacagaacacgaaaagctgtagtttctggagtatttgataaaatgtggcattcttttcaatagtgctctgctgagtcttttttgcctgagacagagaaaaaaaatcagtcatactgatcctgtctttatttactatcttgacattttgtttactgtgaatatttccattcatttcaatttcaaaaatactgcattgaaatactatttctcttcattactgagttgtttttcaaccccttaaattttgtgtccaaggaaagtgcctcactcatctaacactagtcctggtgctgaattttatgggctgtttgacctactttttagcttcaaaaggggatttgggaaactagggtacacagcctttattcccattttgaaagcaagtctatgcacagattaaataaatgctttcaatgttaaacttttatgtaatataatctcatccagcacccaccggccactctacatgcatacaatattgtaatatgtgtgtatgttgagaaaggtgatgctgtttgtggaaaagaaaaattacagtagccgtaggtgaatcacttgaatgcttggcaaatttctatttattgattggtaagtatcaggttaggggcagatttggaagatgcagattcagagcagcaagtgtttattctgtttactttttagttctttgtctggatgcctgtttttagaagaagtgtgttgcccaagcacaagccttgatatctactcattgtaaaggaacatgtctagtgcttgagcctagtttgaaaaatcatgaacaaaatgactgtacagttcacctaaacatgggggaaaaaaacacctcaaccattgtagcattatgttatacttcggaccaggaggtcagagttctaccagctaataaaactcctgtagcgcacatatccccttcatgtg

SEQ ID NO: 9908 - DNA, 2305 bp, artificial
  synthetic oligonucleotide
aatgtgagcctcaccacacagttattaatgttagtcctttgggtgaagttttgaaaagttttcagtttttacatgagtattattcacttttaaaagtcctcccttggtcaattttagtaatttacactttctccaaaatttccattcatcaagattttatattttattagcatagtgctatatgcattatttcttaataatttttctggttcccccatgtttgtgattatatccctttctcattatactgtttatgaattagttctttttttctctctctctgtcactgtcttcctctcttttgctcttgttgtgatttgatttaatttttcaaatgattgtccactttgtttaaggtttccaaataacaacctcttgaaattattcatctattctactgtttgatttcttcttaatctttgatttctgtttttaatttttattattttcatcttcctacatttcttggcatctctttgtgttttctttttgatatttgagttcaattattttatttcttgtaataataaagtgttatttaaaggaagtataaaaagtctcaagttgctacttatagctttgcccttacccttcagttttaaacactcagtagttttcttattacataaattatgattacagtttttactttttctttgatctaagaataatggaatcttttaataagttcagtttctaattgtaatacagtttaccagagaatatacactgtaaatggtttcatttttggaatgaattgagagtttccttgggatctaatactgattagtccttgtaaatactccattgatgcttgaaaagaacggtgtcttactttcatttttagaagacataagatagagtacaaataaatatgtagtttataatttatataaaatattcatgaagtatggaagtttatataatatataacttcatcagcaagtttaaatattttctagcctaattcattttttacctacttgtcctacaaaagaatggtgtatttaacacacacacacacacacacacagacacacacacacacttatatttctttatttaccaattacaagaagatacagtttctactgagtagttccaaggttaaataaaataattatatcacttatattacttctttgcacgtctccctgctgatgtctggctttcttgggctcatacgataatctaggatgtgggcccataattattatttttcacacttaatttctcttttcatatatatatatattatatatatattatatacatataatatatatatataatatatatatataatatatataatatgtatatattatatatatatatatataatatatatatatatatatataattttttttagaaggattcttgctctgtcgcccagtggagcaatctcagctcactgcaagctctgcctcccgggttcacgccattctcctgcctcagcctcccaagtagctgggactacaggcccctgccaccacacccagctaattttttgtatttttagtagagacggggtttcaccgtgttaggcaggatggtctcgatctcctgtctttgtgatccgcctgcctcggcctcccaaagtgctttccaaaatatttttaacatttatataatagctcgtaaccatttttatcccattgtatgtttatttgatttcaatgttcattgctagttatcatatactcttataccatagctcccaattcatgaaggtttttcttcttactccaccagctgatatacatctttaagtaatgttttcttgtttacttttcattgttgttcatttgtttgagaaaaacaaaacaaatttagctgaaaggctgatacaaatcactcgttcatgtgttgcttaacttggaactcatatagaaaagctgcatgcacttcttgtaaaaactacaaattgactacagacctacagatgcctacaagagatgatgaagggaaacatacaatagaccaactaaggcccagaggaaaagctgggcttgaaacctctgggaaagtaggacattcaaaagtagccatgtatacagagagaatttagaaaactacacatataatcgggcaagacattctcagaaaatacctgagaagaccttaagatttcacattgggttgatcaatacactcagagcaagcttagctaagtgttgaaggagcaccacagcacagagacaatcttgaaagaaaggaagagcttctggcattcaaataaagttctgtcaaaacattagctgaacacaagataagggaacagagactttagtaatcacac

SEQ ID NO: 9909 - DNA, 1668 bp, artificial
  synthetic oligonucleotide
aattaagccatcatagtaaatacaatatctataaaccaaccactttaaatgtttttcaaacgttattgactagctataataactttcaaatgttgtgttccccttgaagtgattttcaaatcttttgactacttgtgactttcaaatttactgtgacaaatatattagagatgcctgcatctttgactataacataaaaggacagattcatgttttaaaattaagatgtacagtgaagtatcaaattttttatattcagtcagttcctttgttacatttagttctttttttctattgaacaataccatcaataaatgttcagtacttaacagaaatgcctaatttcaaaagcaacagattcagaagacattaaaaccctggacttttcaagcatttttttttgacaattaaattgggttggatacaaaaatcctactatagtttaaaggaatactggaaaaaaatggttctggaaagccctggacattagtaatttgtcatctatataataaaacatttagttaatttgtggatttgaataacaataccatacagctgtgcaactactactgagatcagatacagggttttttgcccctcaaaataagttaaaacgaatgaaaatgaccagctctgaatgtgaaagctttctatcatcatctactacaaagagactctaaatggcaaacaggaaaaaaacaggcagaggtttatagccatagcatttaccattttatggcttatttgaaaaacatctttatgttgagaaacattccatttcagtaagttaaaatattttcattgtaactaaatgaagcaggtttttcattttgcctttaccaaagatcattttctaacatgccactcaagtgcctcttcgtgtgaatttttgcgtaacactataatttattcaacaactgtatacctttacagtatatctaaatatatacttactacatcgagtatactgctagaaaaatctaccagtgggattaaaaatgtattttcttcccataatgaaaataattcatgaccaatattacctgaagtgtcagaagaggagctgtcttaaattaatatggatcaggccattggaaaacttcagtatttccacttggttatgattttttgtgagtttccatttcagtttttattgaccatcacgttttctatcacaacatgacctgacagttgtatcccgataatttgccagttatagactgtgcttatcttcactgtattacaatattggacagaagtacaccaaatacggcattttcaaataaccaatatttctgagatgttttataccacagcacaagtggccatcagtatatttttaaagaattatatatcacagaaccctgaggctttaaaacactatggacttaccactttcttgacaaagaatttgtaattacaataaaatatttagaaatgaaaggactatgattgtgatgtcatgggtatagattcagtaggttcaatattttccagagtggtatttgacactgaatagcagaattctgaagctatttggaaatatctcataccccatgtgctcccatagctttctttgatcccattgagaatttaaactccttctttcctaaaaagcaaattatttatggtattctcctaaagctttaagtcctgatggaagaatgg

SEQ ID NO: 9910 - DNA, 434 bp, artificial
  synthetic oligonucleotide
ttctattcttatcacttactatcgtgtaatcacatggcaaccatttggcattctctccttaaaatgcttatgaattgatagttgaaacagacaaaaaataaggtttttaaattaagcttaatctgaagtcaaccagtattatgataaactgaaaaacatcaacactacccatgtgatttctgctattaatcctttcaactttttacataacaaatactacagcctcttacaatgacaaatacactttctgaaagaggaaaaaagacctttcttttcctacttcttcctcttacccctattccttgaaaaaactatgtaggatacccttgttgaaataaggtacgctctacccctataacggtaacaatgaaaaaatgccaacccctgctaaaaacaaaataacttatatgtcctcattgtatacaataacatag

SEQ ID NO: 9911 - DNA, 492 bp, artificial
  synthetic oligonucleotide
ttattcatttttttatccaacaaatatttcctgaatgcttactctgtgctaggcaatgtggtagatatttgaaatacaaacgtgaaccaggcacatttcctacacatggcaagcttattgactgatggcgaacactgacatgtaaacagaatattatcatacagtgtggcaagagctgcggttgaagtagaaagtattattggaacataaaaaaactcctaacctaatcttggtggaggtcatggaggatttcccagagactgtaatatctagcagagaactgaatgatgagtaggagttaaccaggtgaagaagattgaaggggtggataaagttggaaagtcagttccagacagaaaaaacagcatgtataaaagcctaagaagtgtcatagagaacatgatgttttggggcgaaattgaattagttcagaccatgtagtttcagatcaattagctagaccatagagtttaaggggagagtgactaaact

SEQ ID NO: 9912 - DNA, 1353 bp, artificial
  synthetic oligonucleotide
gaattaaagagtagccactgatatgacagatagattatttttccagtggtaaaagtaaattgagctgctttctaggggtaaaaggaatataatacattttatgtttctatttgtaaaatttctaccgacttttaaagtaacaatttaaaagaatgctatttttaggctttcagacattcaagtttagcagatactaatagagattttctagtttcaatacccttggaatacagatgaataaacacaagcccagagagcttaaatgacttgcgaaagatcatctattaaaatttaagcagttggctgggtgtggtggctcgcgtctgtaatcccagctctttgggacgctgaggcgggtggatcacctgaggtgaagagttcgagatcaacatggccaacatggtgaaaccccatctctaccaaaaatacaaaaattagcggggtgtggtggtggatgcctgtaatctcagctacttgggaggctgcggcaggagaatcgcttgaacctgggaggcagaggttgcaatgagccgagatcatgccactgcactccagcctgggtgacagagcaagacgcagtctcaaaaaaaaaaaaaaaaaaaaaaaatcaggcagtttttttcacttttttactaaaaattttatctacggttgtgatatcagcaattacacagtttatacagaaatgttaatgactaaatgacacatttggtaaacacgaattatgttccatctcaatgaccttaaaactcaagatgaaactctggctgtcaacctacttcagatatatctttttactgattcattggatcctcactcatctatgatcttaaacttgtattctctagtcagttttctatacctcaagaaagtagaaaattcagaagagaaaaactactttttaccttattcctttatttgttttttggtctaaagtaagtctggtgaatgtgagtttttaatcttgaacgtccaaatgcttgcccatgttttcttctttcccttgccagcaaagaggttttcagataaaaattgcggatgagattcattattggttaaatgttatttgaagatttctaacatccagtaggtgtcatcatttacttgaaaagagtttcaaactttcttactttataagatttcagcttcccttaaatttatttatatacatagttattgtttaaaattaaaagattaattgtatatattaagatgtacaacatgatgttttgatatacatataatgaaatgattactacggtcaagcaagtcaacatattcaacaacaaaaaaattattgttttgtggtaagagcacctaatatctactctcttagaaaatttctagggtatt

SEQ ID NO: 9913 - DNA, 1497 bp, artificial
  synthetic oligonucleotide
ttatgtttgaaagaagtctgagacataggatggatttgtgttctctgatattgtgatggtttttgtacaattctagagaacctttttttttcctattgattgtgtttatacttatattgtttcttcccaaacagagaaaacataacaaagtgcataggttgatagatattttaccttgttcaatcggatggtttttttctttggattgctttcatctttttttttttaatttttttttttgagacggagtctcgctctgtcacccaggctggagtgcagtggcgccatctcggcaaggtaggcctcccgggttcacaccattctcctgcctcagcctccccagcagctgggactacaggcatccgcaaccacgcccagctaatttttgtatttttagtagagacggggtttcactgtgttagccaggatggtctcgatctcctgaccttgtgatccgccctcctcggcctcccaaagtgctgggattacaggcgtgagccaccacgccctgcctgcttttatctttctttcttgctatgtggtcacttaaacagctgtagatctgttgcttttatattagaaatctcagactcatgggtgaatttgacaacaaatgatttgttgtattcagtattctttttcttttcaaactattcaacaaataatagagggggaaaaagcaaattgtgacacattatcttgtcctcctcaaactctgtatgaggagactcaggaggtattaccttgtcagctgattttttaatttctccctcttcacatattatctgaaaagtattctctcctggttattattttgagattgaaaaggaccctgacagcgacaaaaatacagaattagatgttctaacgctttgcagaagctcttctatttctaacatttgaaagaaaaattttggaagttttacgtatcgaatgacaagattttcacctgaattctgggctgtaaataatttacaatctctggagaaattaatggagatgtaatgggtggcagatcaagggtgtgttgtttcttttatgtccttaaaaagggaaggcgttataatctaatttaggcagtcaggaccttctcttattatatataagcatacaatagcttattatccacgtcacattatgttgtgaaagaaataatcaatgagtgtccacagtatggtagatgatggttttctaatatgcagcttttcctggttgccaaggaacttcagcaaagcaattagcaattccctaagaatagtgtattttggtcttacaaaaagcactgacgttaaaaatcccagatacactaacttttttttttctggattgttatcgcctggctatttaaaaagcatttttcaatactctgaatttcatttcatgacaaatgtgatcgttctatttggatcttaaattaccttttaatcattttctcattatctctactatgtaccattctagaggaagggaagaggtgcaggtggatgtctgtgaagt

SEQ ID NO: 9914 - DNA, 1172 bp, artificial
  synthetic oligonucleotide
actatttcttaccaattttaagttagtgtcagaataaatctcactggctatgcaagtgctctatcagtgttgtcccatgtttcagttataatttgtgccactctgcaaactcttacctgcctaccatattgtcagttacagatttccaaaaggaaacatccacagcaattctgttttttaaccaggggcttatgcaaaggctaaaaatgcatgaagagattaaaacagtacaacagaagttatgacacctgtctctgtcagtgtggaagacggtggaaaaatagctataagctcttatccaaataggatagttgaaagagtgcatgcttctaactggggagagattcatgaataaattaggaggaattcaaattagtgctaatgtgtgcaagggctgtgattgttgcctgtagtagttgaaaatacttgtgtctgtcctatccatgccctcttcctccaaatgattgctttgcttgagcttcaccagattcagggctgcagtaattctgggacctaaaaatatatgttagtaagttttactgagaatagattggaaagattgaaactataattattctacataagagctttgtggaattttagttaaatacattttgtcctgtatacataatgcacttagtaatattaacaagcaaataaaatatcagagaatttacagtgcaataaggtaatcctgaaatgttttgaaggtgatgatggggagatgggacattaagaagacatttctaaggcattagccttttctagatagatattattcacctcctctagaaaactcccaactctttcgtggctatgaatgaaaaataagcacttgaaaaaagtcatttctggaattttggactcaaagagaaaatatgaaaaaaaaagttgttttaggaatggttgaatgatagttcagtatttcttcctcaatttcaagtaaaataaatctgcagagtagaagcctacctttgctatattgccttataataggtcagtatttgaagagagttaaaatttttagagtaagataatgctagaaatcttacacaatccaattatttttatttgtttataaataactagtttgcaattaacagaacatttttgcgtgtgtttaagtacacttacgtaaccaaaattgaaaactaatttcttttaccctaatt

SEQ ID NO: 9915 - DNA, 440 bp, artificial
  synthetic oligonucleotide
ttccagacatcctttgtggaggaggaagggaaaataattttttatgttatttttatgagaaccacattttctgacctttcactaaaattacgagtgtgtcccactttggaaactttttcctctaaatactgaccacacaggtctctaatacaaaatagagatatttcaggagaacctgtaaccagaaacgagattcaaaggaaggtggggatgtaggaactgtgtttaacataagtaattgataatcacagcaactttaaaaaataccgtaaaaaaagaaatttcaggattagttatcttggcagtggatacattctatttgtgtgagaaagggagaatttgactgcacatgctgggctgcctgccctccaccctccaatgcttcaccttcacctccctttctctaattattttgaaagttctgatatatatatatatat

SEQ ID NO: 9916 - DNA, 778 bp, artificial
  synthetic oligonucleotide
aacattaagcagttgaaaatatcatagtattaaataactattggtgatatgttagtacacaggcagctatttacatatgtgctttgaaggacactaaagagcttgcccttatgctaactattttctacattagtttgtttcctttaaaatatttttatgttttaaacatttaacctccataaaagccttgttcaattacaattattttacttccacctgtcacagtactatatagtactcaaataagtttatcaaattagtagagattggttcagaaagaaagaggacatagagcagatgaaatttgattgaagtggggcaattgaaacagtgaaatgtccagaatgcaaattgtttagtgagaagagaaagcttaggtgactgggccatgggaagtcctgaacagctggaaaatagaatgaaggctttaagttcttggtgggtgggttgatagggattgagaaaaggcacaaaggggcactgaaggacgggttgtaagccaccgaaaacaaaagttttctattcacaaatttgctcatgctaaacctgcttcagaaatccttgaaagtagacatttgcatcaataaagcttttattaggcagaaaggttatattttgtgttcaatctattgagaaaatccagcaagttctctacctacaaaggttctttaaatgtagtgctttcctgctaccgtaatctgatcatgcaacattagctggaaattgcaaggagaaaaagctaataaaactactcttgtaaacccaacaatacaggatc

SEQ ID NO: 9917 - DNA, 570 bp, artificial
  synthetic oligonucleotide
aaaaattaaccatattctgggtgttatagtaagtattagccaactttaaagtataaaagccacactttaaattacacatacaaaatgtgttacttaaacagggaagtattaagctagatattgataagaagaagaaaattaggaaacctccatatcactgtaaatgaaacaacatacttctgacttctgtataacccacaggtcaaataataaattgcattggtaattagaaaatattttgagatgaatgacagcatgattatgataaaaatgtgtgcaatttatctaaagccttgttttgaaggagatttcttcccttaaatgcacatattagaaaaaaaggatgactgaaaatcaataaccagaacaaattaaatgtaacaaaacagaagaaagaaaataataaagataagagcaaaagttaattaagtagaaacaaatgtacatcagagaaaatcaagatagctaaataagttcatgctttgggaaaagtaatagaattaataatcccttagtgaaactgataaagtaaaatataaattttaaaaaatgaataacaacaaaaataat

SEQ ID NO: 9918 - DNA, 818 bp, artificial
  synthetic oligonucleotide
ttttttttatctgtaatgtaaaaagataagataaaaccacaggaccctttctgttttgaaattttattaatttaattcaaaaccaacttcttaaagctgttatcaggattctgtacaagtgctttataaagggagaaaagtgtgatacaaagtcaagttattattttattaaatcaattctcatttttctattgactcacgttacaaattcagagatactttgtcatcctagctaacagatcttcaacagtcagttgctcctaaaggtgtatctctaagtttcttaggccagaagtctccatgtaggtaagcaaatgtacacacaagtgttttgtgtttgtgtagaagtatgtgtattgagatgcaaaagactagaaaattaaacaatcttttttgtaaaaagaatagacagcatctaactgagttttcatatatgaattatttggttgtttttataaatagggcctacttgaagtagcatggattacaaagggagaaatcagccttaggtaaatgaaatgtaacttctttacttcaagattcttcaggttgttttatttcttatcattggacaactactatgagaaatctacattcattttgggtttctgtctggaatttaaagcagattttcaatgatttaattaaaaaggaataaccttttcatagattttccctacccttctccaaattctgcctcccacaatgttaacccaattatagaatacgaaaagcctttcactactgaatttgttgtgctaattgagcacagaatgctctcttgcctctgtaaatggcttacatatgcaatctccaat

SEQ ID NO: 9919 - DNA, 925 bp, artificial
  synthetic oligonucleotide
cctactcccataccgaccagaaggatctcaaccaccaaaaatgttacaaaatcactgtcactgtttacctagtgatttgttgagtattatattattgtagtgtatgttttcataatgtgcaccgttaactttgcgcaataatgtaaaatatctcttgcctttttcagagatttaccgtctctggaagctgttagaagattgttagctattttaattagtacagactgaaaggtctcctgtagtttaatctgcatagaaagtcacaataatctctggtaaccagtttggctgcttaaaaatgttttttaattgttacttttgacctggaaatgcatatagtcataagctatattcaactagggaatgtgtgaggaattactatatgatataaaaagaggaaatgtaacttcctgacttaaattaaatctgatgaagttagtagccatgttattagagacaagataaatgtccagaattcattattttgtttcaaacttagtttatcgtaaatcttccccatgacatataataacttttgtactgtttttcaagttatttgatagcaagttcaacaatgtaggtgaatgacaatgtgagcagcacgataatgactcttcaggaaaatcagcctttagggcacaaggttagaactacatgggcttttattcaaataatatatatatatatatatatattcaaaaatttatgattgatctcataagaccatcagctaatatactgtgtggttaaaggcacaagctgattatatataacaaaatttatattatgtggtcttgttatgttacagaactatgtattaaaagaaatggcagtccaatttgatctggtataaaaagaaaaaatagttagaaagcacagaaactagttttaatttttccctatacaaaagaaatatcaaatcacg

SEQ ID NO: 9920 - DNA, 2855 bp, artificial
  synthetic oligonucleotide
ttaatagtgaatatgtctggagaataagatttgagaaaagaaggtttacattttctcttttatacattgtctgtttctatttgccataaatatacgctattattttatttaacttttaaattcaggggtacatgtgcaggttcgttagataggtaaacttgtgtcatgggggattgttgtacagattattttgtcactgatgtattaagcctggttcccattagttatttttcctaatcttcccgcttctcccaccctccaccctctgataggccccagtgtgttgtttccctctatgtgtccatgtgttctcattatctagctcccacttataagtgagaacatgcagtatttggtgttctcttcctttgttagttagctaagaataatggcctccagctccatccatgttcctgcaaataatataatctccttttatatggctgtatagtaatccatggtgtatatgtaccacattttctttatccagtttatcattaatgcatatttaggttgattccatgtctttgctgttgtgaatactgttgcaatgagcatacacatgcatgtgtttctataatagaacaatttatattcttttgggtatatacccagtaatgggattactgggtcgaatgatatttctctttttaggtctttgaggaactgccacactgtctttcacaatgggtgaactaatttacacttccacaaacagtgtataagtgtccctttttctctacaacatcaccagcatctgttatttttggctttttattaatagccattagtgtgagatggatcatctcaaaagcttctcaaactgatgaacaacctcagcaaagtctcagaatccaaaatcaatgtgcaaaagttactgatattcctatgcaacaacagttaagctgaaagccaaatcagaaaggcaatccctttcacaatttccacaaaaaaaaaaaacaaaatacttaggaatacagctaaccgggatttgaaagatacttacaagaagaactacaaaatactgctcaaataaatcagagatgacaaaaacaaatggaaaaacattacatactcatggataagaagaatcaatattgttaaaattgccatactgctcaaagtgttttaatagattcaatgctattcccattaaaccaccattgacactattcacagaactagaagaagctattttaaaattcatatgaaaccaaaaaagagtccgaatatcctaagcaatcctaagcaaaaagtaccaagctggaggcatcacggtacctaacttcaaactatactgcagggctacagtaacgaaaatagcatggtactggcacaaaagcagacacctagaccaatggaacaaaacagagaacccagaaataaagccacgcagctataactatatgatctttgacaaacctgacaaaagcaaacaatggggaatatattccctattcaataaatggtgctgggataactggctagccatatacagaagatagaactggagaccttccttacaccatatacaaaaattaactcaagatagattaaatacataaatatgaaatccaaatttatgaaaactctggatgacaaccgaggcaatatcattctagacatagaaataagcaaagatttcatgatgaagatgccaaaagcaattacaagaaaagcaacaattgacaaatggaatataataaaactaaagagcttctgcatagcaaaggaaactgtcaacagagtgaccaagcaacctatagaatcagataaaatttttgcaaactattcatctggcaaaggtctcatatccagcatctataaggaacataagcaagtttacaagaaaaaaaaataaccataaaaaagtgggcaaaggacataaacagacacatttcagaagaagacacacatgcagccaacaatcatataagagaaagctcaacatcatcgatcattagaaaaatgcaaatcaatacattatttttaatgtaagtacattatcataataaatataaatatttctacccctgaaataaagaaattgtttttgaataaggagtagattctaagcaaatactgggtgattaatatactatatttatccatggcatttcatgcctcccctggaaatgagagaagttaatatatatgtttaatgactttttattatttttagtatatttgtaaaaagttacattatctgctctcatcccaatcttggaactagacattaactcacttttgtgaaaaaattacattatctgctctcattacaatcttggaacaagacattaactcactttggatcattgatcaaattaaacacacacagtcaatcactagtttagcttatatattacaaaagaggactgaatcctaatataaacacatttaattatgtctattagggagcagtttggaggggggagggaatgagtcttttcatcaaggaaaaactcagactttacttaatgtttaaatctgaattgtgagtggtttcagaaagtgttctagtttaaataaatccagaatcttcgaactttcctgatttagtaaagtaggggctaagaaacaacttgagcaatcagttgctgcttattattattttttatttgcgatttaactgtagatgacaacagtggaattagactgtgctgcaatatcttagggaatgctaccatcttatggtcaagagtggaaagtccagcaaaaacaaatgctttgagaacaatctaggtggaaggaaagataattcaatttttaagaaggtggtacagcatataagagacatcagttcaaactgaagtgtaccaatttggcaagcttcaagggaaaatgaagtagataca

SEQ ID NO: 9921 - DNA, 1421 bp, artificial
  synthetic oligonucleotide
aacagatctgagagatggagaaaaaaatgtccccatgactttgactaagatatgaatcccctatgctttttaaaccagtttatctatggaactagtacttgcaaccaaaaaatgtactaatggatttgctgcaaaatcatagttaaagacattattccagttccatgccccttgtaataaggttcttctttgttaaatgctttaaaaatcttaggaagcaaaaagtatctgttgaagaattagcattcttcctctcacataattatgtaacctgctaaatttctcttcttgcctttcctgtcaggaagctcagagttaaattaatgttcaagtaaattccttattatccctggctcttggcgtacttttttttcctttaattttcatgattttgtgtttcactttagcatccttattgtatatatgactgttaccataaacaaccttgaatctcttttagaaagagaataaaatcagtgtctggcacagaaacagaatacacatttgttcagtaaaaaaaaaaaatgcatctattaacaaagtatttctgtcagaaacggaacgatcagagatgttacatatggtggtgtactttacaacacttcctttaaaaaaaaaaacaaaaaagtgtagaacactgtacctacattcagaaaatataccaaatgtatctgagagtcttaaagcaaaaggaaagaaaaaggcaaaacctgggttctaacctatgcttaggcatggaggtggggcagagggatgaggaaataacagacctagaaataggttgctttgtgcttgggtagagtaggttctaggttctagaagaagccaatagtaaaagaatgtaaactctatcttcagaaatatgtccccagcagtttcaatctgtttgtttgttcaagaggacacatggggactcatgggagaagcaaattgtggtctgatacttctatctctcactttgaggtacatcgagggtacctcgaagttaaccatcctggctaacatggtgaaaccccatctccattaaaaaatacaaaaaaaaaaaaaattagctcggcgtggtggcgggcgcctgtagtcccagctactcgggaggctgaggcaggagaatggcgtgaatctgggaagtggagcttgcagtgagccgagatcgcgccactgcactccagcttgggcgacagagcgagacttcgtctcaaaaaaaaaaaaaaagaaaaaaaaaaaaaagaaaagtgtatcatgtttagtttggtaagcctaaattatttaagggtctcactgaccaaaaaaatgcattacctattttggtagctaatgcttaaaatacaactgcagaatgtagtaatactttcataagaataaggtttttaaagtattatgtataaatggtgatcagatattttattaaggggctgggagat

SEQ ID NO: 9922 - DNA, 1015 bp, artificial
  synthetic oligonucleotide
aaacctgcccactccacggagcatgcgcagcgctcttcacacatgctcagcaggccctctcaagtccacggagcagcattgctggcgggcggcaggattctcaaaaaggatgctggaactgggggaccctccagagcacttgaggaatcagggtaagggtaggactccaagagtatctctttgcagggctcacgaagagcaggtgtcttatatgccaaaccacgcccatttcgatacttagtgacaaatactagggcagggattttagtacatcatacattatcctcctagaaggtaaaggcaggataacccccatttaaaaaaataaatatacctgtcctctctagcccccaccttacttgtccctctcaggatgctcctgctggttgccttcacactattgataacacacaatgtttctcttcacacatgcacacacacaggcaaacatatgccacttaatgaactccacttgtggcaacaaaggcatgattccgaagctagcccatcctccagccccctctgagaatgttgggtctgtagtgacaataatcatagtttttagtaccttcttcaaagcgagctttactacttcgctactctaagccacacattgtactgggagctggcgatataacagagataaagtataatcttatacgggggataatcaagatgcttctcatcaaaacacttcagagctgaaagtttaaaagttattccacatttgacacttcaaagacttaaaagagcaactgtaacagcggctaaaccaactcaggaccttggagaggtttctaacgttcataaaaggcacaccaccccctttacccttctacacctagggctgttgacctatgccctccatttatttcatcatctggtctcaagagctaatgaagcaaagctggccacagagattgcactgaattacaaacaaggataactgataatgtcctctcacttactctgctgaaaatctcgaggagaaagtgagcttaacgaacagggttct

SEQ ID NO: 9923 - DNA, 1236 bp, artificial
  synthetic oligonucleotide
gtctttgaaagctatgaaatatctaggaatagacttaccaaataatgttttaacgcctgtttaaaagaaaaataaactatcaaactttactgaagggtatttttaaattttcacaatatttaattgatgaataaagattgaatatattcaaggtgtacaacatgatgatttgacatacatatacattgtgtaatgattattacaatcaaattaacatatccatcaccacccatgcagcacattatatacccagaacttgttcatcttatgactgaaagtttgtaccctttgaccaacatctcatttacctcactgctatcccctggcaacctccattctactctctgcttctattctgcgtatatgtccaaaaaaaaaaaaaatgaaatcagtatcttgaagagatatatgcacctccatgttcattgcagcattattcacaatagtcaagattagaaacaacctaagtgtctctcagtagataaagggataaagataatttggtacatatatactacaacagactgctatttaaccattaaaaacggaaattctgccatttgcaatggcatggataacccagaggacattatactcagtgaaataagatagacacagaaagacaaatactgtttgatctcacttatatgtgaaggatatttaacaaaaaatcttgaatgtctttgggcatatatcctgtttctcgatgaaagactaaatgttgaaatacggcgagtatttcaaagtctagaaatttaattcagttcttacaaaagctctggatttgaatggagtgtgacattcattcatctagtatttgttgtctgtctactgtgtattggttactatagtatacacaataaaatagatcaagaggacaaaagagaatatccaaacaattatattgagtatatttttgtacacatgagggtaggggattgatacgtggtacaggtggcatttcagatcagtgtgtaatggaaaggatggattttttttttccaagaaatatgttgggataattggctgtttgtagaattactcagacctttaccaactatcatgggaaaactaattctaggtggaatacagatctaatcataaactagaatactataaaaggtatgagaagaaataagaggaatacctgtttaatcttgagataggaacagctttcttaagcaaaatacaatctagaagccattaaagaaaaagttgacatatttgactacatca

SEQ ID NO: 9924 - DNA, 4298 bp, artificial
  synthetic oligonucleotide
taattctatcaaaaactttagtggtatattaggttatagagacctgaagaatgtatctagaatctagaataataacatgctttatttgtaaatattcaaatgatttgcaaagataaagagttactttctttaggatcctatcctttccctgcttaaacactgttattgattccaaatgcttatagaattaaagctaaaataggcaaaacataagactctttgcttacgcaatctagtccccacctacctttcatcacatctcatcactcttttccccatccctcacccaatgaatttctcactgtcctcccactttttgcagacagaagctgaaagtgacacattcatgagatatttagtgtccacttcattgaggtcccttgttcaccttttcctttctatacctttcttcactctccttcactttcttcatcgaattgtctaccattacaaaatagaaaagaaatgaagggagggaggaagggaaactgcaacacacacaggttttattggggtgaggcatacctcttattactctggtcagtctaatttgtcaaatcctcgagggtagggccgatacattttttttttaacgtcgtccaacatctattagaggttcagtcattgattatcctcctccctttcttcgtttcccttgggaaacctggaaaacagaaaatcttcccacagaaactcctcaggggcgcgccgagatctgggcttgcgcacttggacttggccggcgctcagcccccgcctcaagccggcggggtctcgcactaacctagcgcgggcgcctcgatctcccgcgcgcgcgcgtgcgcgagacccccctttggccccctaccctgcagcaagggtagcgtgacgtaatgcaacctcagcatgtcagcagcaatataaaggagaatgaggcggcgcgcctcccagacgcagagtagattgtgattggctcgggctgcggaacctcggaaacccgaatgtgaggaccttaagggatccacagctgccgccccccgcagccatccagagcgcggtcacagtccgactggcggcacggaggcggcggcggcggcggcggcggcagcggcggcggcagcggcggcggcagctgtagctgcagcagcaggtaaggagactcctgacgagaaactagagggacgtggatccaccgcgttcagtgtttcttgtctgaggggaggagaggctcacacccagcgtgtagcgtagggcgaagggaacaatggaagtggcgtccagtccctgagctttcctcccgcctcgggcggagttttcctcttcagccgcagccgggggctggaggaattgagggaagtaagggttttcccccttagccaacctcctctttccctaggccagagccccagggagctagagccgtcgttgagaccgtcggtggtttagggtgacggtaaaatggcggaaaacaaaacggtgaagtgaagaatgcagcgtccccctggcagtttctctcagctctccctccaccccatattcttttcactggcgccccagtcgcctcgcccccgccccctgaccgagctaatagtaacctttggaatgcgcgagggatggcggcgtgtgcgaggaagtggcaccgaatcggcattttaggggattgggagccgtcagagcctgggagttggggggagggggggggcgtgtgcgacaactgtcgcctacactaaaacaccaccattttggttcccaaccgtctcccacgtagcggggcagaggaagctggaggaggctgaggggctgggcagcacggcgtgggtagcagcggtggcgaccgctgcaccaagtgagaggagggaggaggggaaagggtattcttgtctcatcggtctcttcctttctgctgcgaaggttctcttgttaggtttaagatctagtcagatgggtaatacctcagagggcacgtgtgtgcattctgctcgaaatgattgaaacttggcatggtcgtgggaaaaggagacttatgcgggaagagggctgcgtccaaagctgcaatactgctacttgccagggctcctttgtctcccatctctgcaaatactactttcgcattctcttgttctgccgccttaccatttctcatctatccgtcaccctattgacatcactaagaagctaggtcctgaatgagctatgttagaagagacagattttctttttgtgatttctactccccatgcattaatggaaagatgtttacttgagacgtacttggtgggttatctccattcaataaggatgtgagatacacttagagaagaccaagaagcctagctatctctaatggttattaaatacttaacacactgctgttttcatacctcatttattattgattttattgaaacttcctatgtggggaaagatactccggtttatttatttggtattcacacagtgtaatacttttataatagttgcactatgtgttgtaatttttacacttcattgagtgctagtgcagacttttcagtatggatttggcaaggataaagcttgcccttgattctctttcactttctaaaataaggtgttgtttgtgatttttaagatgtgctttagagaagattttggtttaatcaagtggtagcattctaagtataataacgttgctaatgtagtgagtagttgtttttgttggaatccgttgggttgcttttaacattactacagatttgagcatatgaacccttcccagcctcactatgcaagttcaggtgtaaagaaaaatattaagttgtgtaagaaacttagtttaaaatattttaaagtatctgattttgaatgtatttttataataggtaaagagagcgttttcccaaagaaaataacatagcacagaaggaaaaataaaaagaaattgctgcagattttactttatgtgagaaaatctacaatttcttcgagacactcatataaaggtgactaacaaattacttattgttttatcttatttaacagttaaataaaattaagtttttaaaaacattttcagacatttgtagttgttctattagttatgtggtaaagaaagtaattactctaattaaaatccaaatagtacactgttttaaatgttaagaacatgtccctttcagatttattttgttaacacacaggtagtttattgtgaactctcttggccttggacctcattttgcataatagcaaagcagaaaacaatggcatttgaaaaaagatacacaactaagaatttctaaaattgtgaagtttgctcatacataaagtaattctgtctgaatcgtttgttatacagaaatgtcacctacttctgtagcatatttatgtatatacctgaaatggtgataggggttcctctgagactctcctgcctcctgaataccaatttagccatcctcctttatttaagaatatattaagttgtattacgtgtcacctttctgaaactttcattaaggttgcagctttatctgttgtgcaatatggtacaatttattaagcagtcctacgtgaaaaggagataagtgccttataaaattgacaggtttttgttgatttacttagaatcttatgtttgaagagaaaatgcacatatatgtgtctaagaaatacattgagtgacagcatctgactttatgttccatactatcaaatggtcgtaaatataggataagtcatttgaaatgaaatagattgagcccttgctttcaaaaccaccttgaagctagcataattttattaatcactaataaaaagtcagttgtacaattacaagtaaatgaaatgctgagataaataatttgctaaatgtttgtatgtgatcgatcttatttttaccatatttaggaagcagtcatgtttcatgagtcctcaaaactgagacaagagaatgtagtagagtgaggccagaagtccttactggttcaaagaactccggggaaactgggatagaacattttacattataagtagaaccctgggagccagaggtgaatacaagtttatctgcagagctccgctgcagggctgatctgggtctggaagaaatggatgagagccagtggatgaaattcactaatactagacatctgagtcctctagtaatgtataaatatcctaactattgtttgttgtcatctcgttcttcttttataacctatgttttaactggaacttttagcactgcagttttgttgttttgctttcttctaccacttccctatggctcatcagcttgactgtgcctttgtctccattatttttggtttacttccact

SEQ ID NO: 9925 - DNA, 626 bp, artificial
  synthetic oligonucleotide
aatgaatggagatttaccaagaatgtattgacacacaagatacagttaaattacaagcaattttaaatggttgccttctattctctctagacccaataaaggaagaaagggaagaatccatagttcagttaaggtttatagtccttacctctccagattggatataggacatcttatatgaaaaacaatggtggagggattttttttttctgatagctgacagtttccaaggtgattgagccctttcatatccagttgggagagaaatagaacctccactagggatatatagcagccacagtagattcattagctattgccccaagttgtcataaagcgataaaaattgagcccttatatttacagggtcactgggggaagtcttgactattagtgacttttaatgagagtgcccaggcaataagaggcttggctgccagagtaaaattacttactaacgtcttaagccatatagctagaagtcaagcacaaagtttgatctcaaacttaacatcagtgcttaaattcaaacttctgtatttaaaacaagttgcgttagtgagctttatatctaaggaccataccttaaattaactcatggaagagtctgatgactaaataaggaa

SEQ ID NO: 9926 - DNA, 618 bp, artificial
  synthetic oligonucleotide
aaacatctctacactgaaaactataaaacattgacaaaagaaattgaagacattaataaatggaaagacatcccacattcatggattggaggagtcaatattgttaaaatgtccatactatccaagcaatctacaaatttgatgcaatcgctatgaaaacatgaaggatattcttcatagaaataaaacatcctaaacttcatatggaaccacaaaagaccctgaatacccacagcaatcttgaacaaaaaaaaacaagagttgtcacactacattacttcaaaatatgctacaaagctatagtaacaaaaacagcatgatactggcataggaactgatacagagaccactggagcagaatagagaactcagaaataaatctacacatttacagccatctgattttccacaaaggtgtcaagaacacacattggggaaagaacagtctctttaataaatgctgttggaacaactggatatccacatgtaggagaatgaaactagacccttatcttacctcatgtacaaaaatgaactcaaaatggattaaatactaaaatctaaaagccaaaattataaaacttctagaagaaaatataggagaaaaactatatgaca

SEQ ID NO: 9927 - DNA, 1092 bp, artificial
  synthetic oligonucleotide
ttccatttttaatagagattttttaataattaaaatttaatttaaaataaaaatatctctctctgagatgagagccggtgataaaagaaagtttaagccttattctgagttattcttacatagaatgctcatacgttttacataacagttatttgccatttaataccaagataatcttcatacttttcagaagttttggagagttctgaaattaacactatgggaatactaatttgaaaaaatgggcatttatttgaaattaatacctgtgtctgactactgaccaagagtaaagacaattttcctcacttgtaagcatggttttcttttgtaaaaaattagttacaaaaaaagaaaatgtcactttcaactatacaaaataaattatactgcccagtaatttaaaaattgttttctaagttagtacagtcttggattttttttaaaaaataaatttactttaataggctctgacaagagtataatgtttgactgtacaaagctgtggctgaaacttgtagttagtatcaccagctagcttcacgattcccatacgattcctgtatatgcaactgtaaaaaaatacaaaactcagcagcaaggaatttcccatttgtcccattttaattgaagttaaaaagaatatgggaatccatgtaaatagtttctgagtaatgtgaagtactaagtctaatgagatatttttcctgcttaagtttcaattattaaactgccacttcaattacttgtttacaaactcgagaaacattcactaaagcaacttaatatctttacagtatattattcagataattgcgtatatctggagtataatctaattctttgatgttattaaccccaaacaacagacatttaaatcaatataactctaattgagtatattatatccaacgagtcagattttactgaaagagagcataccaacatgtactgaatttcaactttgccctggtgacatcaaattgcactacagataaactaagagttgtcaaaatttttggctggtagccccccttctacatatgctttacaaaagcaattttggttcctatcaaggtacaaatcagcagt

SEQ ID NO: 9928 - DNA, 1720 bp, artificial
  synthetic oligonucleotide
gtctcaatcagacagacttagacttgaatcttggttttgctactcacctagctgcacaacctcagataagtcacttgacttctctgagcctttgtttcctcatctatcaatgagaatatcatgatctacctcacagaattcagttctgttgttagcaagggtacttgccctatgaacactatctactcttattatccttcagaatgatattttagaagcattatttccatctaacactaccccaaacataaacctattttcaccagatgccagctccaatggtgaacaataataaaattactcgcctccatttggcccaaaaataactcttacttagggtaggcagttatacacgtggttatttccatggctgtgatcaacaatgtcagaagtcaaatctctgctattaaagcaaagccaagaatggatttcaatactgaacatgatttgagtccaaattacataaagccaaaatgactatcatttgtgtttttccttaatacttccatccaaacattcccataagtttgtgaaattcataagctgttctaatgttaaatggcaagggcctattatcttcatgcttagaatgactaaaatagcaaactaataatacagttaacaatgtcttcttggccaagatttcatatttcttcccacccattcaataaacagaatttccaggatacaggaggcatgtagtaggttctccatagatatttgctgaagaaaagaaaaagaaaatggggaaaggggagaggaagggagagagagaacaaactgtgctaggtagtgagaggttgccatacgttttttgcaagataatccctagcctgttagagctcagagtctatgtaacaagaatttaaagagattaaaataataagtgtatttaaaactgtgatagaaacacaatggaaagaaacactccctctgtagagggagtcatggaaagctccaaagaacaggagaaattagctgggtctttcagggtctctaacaaccctaactgaggagtgcagaagacggaaaaaggaaagtggaaaggagcattcctggcaaagttaaaggaagggagaaccaaaaagtgatcctttaaaaaaagtgtttggactggcctacttcacttagcataaagttttcaagggttatccatgttgcagcatggatcagtacttcattacttttttttttaataaccacgtaatattcccttatatggatatatcacatttctctatccattcttctgttgatggacatttaggttgttttcacatgttacccattgtgaacactgctgcaacaaacataaagccagtgacagaaggacaaatgccacatgattccacctatatgaggtatttaaaaataggcaaattcacagaatcaaaaagtggaatggtggttgccatgggtttgggggagagggaaatggggagttgctaatcaactagcatgaagtatcagttatgaaagaagaataatttctaaagagctgctctacatcattgtacctatagtaaacaacactgtattgcacacttaaaaatttgttaagagcagggatctcatgtcaagtcttcttaccaacataaaacaaaatttaaaaaaatttccaagaggttgaagccaaattatagtatctgaacttgagcctctgaggaatagggagtcttgaaaggactttagccagatcatggtcaaatcagggtttcaa

SEQ ID NO: 9929 - DNA, 1006 bp, artificial
  synthetic oligonucleotide
tgcttattctaaatataattttttcaaagacacttttgggggttttaaatttttcttctaattttactgttctcatttcttccttggcttcaagcttcttgataatgtataaataggtatatatgtgcaatttaaaaacatttgtccttgagtgtgtctatttttccttcttttatgtgcctccttttataacataagctcatttgagaagtccctataaggtcacatcatctttagattcattctccttctattttacttggggattatttttagttgtatagtgaaaattttatttttgagaacttcccacttcttaatacaagcttctctactagggtctcagtccacaggttcataacaacattttctctgaacttaattgcctcagattacttagacatcaagagttgcttgattttaaatttcttgtctttgtcctaaatttaggaaatgcctctcagtctaattcttgccttatgatgccacaggacacaataatgtagtgttttactgattctctggggtgttacaactttaaagttctgacaaaggaaagtgccctccaacaggttactgtagcctaacccatgacctacatgctgatttcaaaaaagaaatgctaaatcaatctaaaacattcattttaaattggaagtaaaatatctagctcagaattaaaggaatttacctgaatatttggaaaaatataaatcttttacttaatgaatattctttaaatttctactataaaattctcactgatcattgttggacacacaaaaagaaacatttcatgtctatctagctaaaggaaaatattacttctgatgattcctgttgctctattaatattttatttggttagtatattttattattttttgtaaattcaagattcctgtaatacagataaagcaatgggcacacatgaaatcaagctgagaaaatgtacttctgatgtttgaggtatttttgttttagtttaatcaatttgatcattttt

SEQ ID NO: 9930 - DNA, 1235 bp, artificial
  synthetic oligonucleotide
cttctgaactcgctagcgtctttctcccggaagctaggcgaagccatctattagcccccgcagagtttgggagagatgcgcaagtggaattggagctgccacctcactttccacgatctaacccggtgtaaggtggcggaaggggcatggggaggcacgttcaggagtcgcgctttgcgtttccaccccgacaccagcggagcgcggagcggatgggttcacagcataggccactttgagaactctgcgtgacatctgggagttctctcgtctggcagagaggcaagaagcagaggcaccacaccgcccccttctcggactggatctctgttcttggtcgagcctggacccactcaggtagtcggacgccggccagggagtctccacctcctcaccagcggcagccattcggagcgctcgggcgcagaagggctggggcccattggctgtgggacgctgccagtctccggagggggtgtggtgggggtggggtctggggccgcagcgggtcggggctgctcactgtttgttgagcttgagcgtgagccggctgctgaagacttgcgaacagttcggagccagcgagagcgcgccagagagagcgagagtgagggagtgagtgcgaggggatctagaggagtcagggcgagaaagcgagggccggaggacccacgatagagacagagtgaccatggctgtctccgcatctccagtgatctctgcaacttccagcggcgccggcgtcccggggggcttattccgggccgaacccctgtactcgactcccagagagccccctcgtcttactcctaatatgatcaatagtttcgtggttaataaccacagcaacagtgccggaggcggcggcaggggcaacaccaacaccaacgagtgccgcatggtcgacatgcacgggatgaaggtggcttcgttcctgatggacggccaggaactgatctgcctgccgcaagtctttgatctttttctcaagcacctggtgggaggcttgcacactgtgtacaccaagctgaagagactggatatatcccccgtggtgtgtactgttgagcaggtccggatcctccgcgggctgggggccatccagcccggggtaaaccgctgcaaactcatcaccaggaaagacttcgaaactttgttcaccgattgcaccaatgccaggtgagacactcgtttcttggctctcccacttctcttacccctttggcctcttctgc

SEQ ID NO: 9931 - DNA, 434 bp, artificial
  synthetic oligonucleotide
ctgctgttcatatttaatattaaatatttaacaaaaaaagtttatggaatgaaaatgaaaaaatatagaccagtaagtcagatataaaacttattcagtagaattcagctttactagattaatgtatattttatttgggtaggctaagagtaattctaccattatctctattaaattcagtctaaatttatacaacttggcaagtgcttgctatgattttaccttcttcagactagaagtatacttccttctagtaagagtcaagtgatgaaggttctagtttgtccctctccttttaacttcctgtgtgacattaaggcaagtcacttatcctttctcagccctatttatatataaaaggggaattataaccgccttacttgcttccctaagtagttggaaaaattgagtaaaaaacgtgaaaatttgtttgc

SEQ ID NO: 9932 - DNA, 396 bp, artificial
  synthetic oligonucleotide
catattcacaataataaatatttcacagttctaatgatttaaccctaatcactctttttacctcattgaactcattttgtgtatcttttagatgctatttggcaggatcccttttctaaatgccatcagatttctcctaatgatatgggaagcattcagaatatgtttctggcaatccagggtgatattttaaatagtggcattgttcttgattttgttttgtgctaaccaacttttatatatagctttgtctttattggaaggccttcaaatattttcatagcactagacacatgtgatacattcttacaaggagctaatgaagtcctttgtagcaaagaataaaaggccaaactggtagtttttcatagttataaaacctactcttaaactttg

SEQ ID NO: 9933 - DNA, 2060 bp, artificial
  synthetic oligonucleotide
tactatctcatggagtttacagtgtcattggaaaagtagacctaaaacaagtaaataggtaaaataattacacattgtgataagtgctaggaaggaaacatcattttaatgagcaattcagggttggaagttgacaccaagttctccacataggcagtaaactaggaagtaagccagtttactactgtctcagtgtgatatcaaaccatcaaacacaaagttagctaaaagctgataaagcagtaattgtgtccaacgttttaagggctgcagagtatatctaccataaatgttttgtttggcttctgaagcatttctttagtgttttctgtgagtcattctgaacacacaatagcaggacatgatcatcgactggaagacatgaaatataaatagtgtaatggtgctgaaaaatcccttaccggaggctggctagaacccctatgcagatcaaagcacacaattcaaaggtcacccatgatgtctagccaaacctacaaacatgaatagcaagactgaaagataaaaaatttccaacagaaacattgtagacaaagatgacatagcattaagtgatctaaaatttatgaaggttttgaggaattttaacgtttaaagctttatacgacagaaatgatttcaagcaaattagctaataatcagtttatgtatgtgactgatatttactgaatttgaatatgtggaagaatatcattgaaaatattagttggtatacatccatagtaccactaaagatatttaatgggcatcatgcttgatggtacatatattcatatatcacacatgttgaaacacttattgttgtaccatgagaagaccaagttattctattttttaaaatgaacattgccttgaaaaagatatttgatgctgtgaacagtaatcctatttttgatattctttgtttttgtaggacatatgagaaatatcattgaaactgctgaggctcctcggacaggaccaacaaaatattgtttgtataaaggatcatctgtcagagacaattgacatagggtcttgcattctttgagttatattgacactctatgttaatacaagagtgtatatatataaccaaaaaccctatctcctacaaacaaactagtaaaaaaattccataggcccatttatcttcaccaccaccccatcccatattcaattttttttgtttttcctcttgactctgactttaaatctcactgatttttaaaagactcaagtgtgtgcatcaaaatttatcagaagcagcaaatacttaatataaccaaagtttttgttattcccaaataattacagaaaaaaaattctgagaggaagcaaatggtcagttttaattgtctgggccttggttcaaaaaatcatgtgtttggagatttaacagacaaagcgtttgtttggatgcctcctacaaacttaaataggcctgaaatatacaggctattaaatttacatctttaaaataaggatatcctcaggtttttttttctgttaatatatatgtttgccaaacatttttcaggattcctaaagtgattaaatgcctttaaaccagctgctgtggagcaagtgttgttatataagatgcataaagttatcatctaagagtgaggaaagacctttaaaagttccaacagtggaaatgcaacagttaacatgatttggtcatatcttcaaagataacttttaaaagttttaccagcacatatttattggcagtttatctcctactgatgatgtctgatgggaggtggggaggcattgcttgacttatacttcatttatttattacattttgttagcaaatagacattgtttattgtattgggccagaaaaataaattgcatgactaaaagatattacctgtgtgaggggcaaccgaaacctaatttagtagtccccaaaatatggcagtatatgtcaacagctgacttcatttcaaagcatagggaacatttttatcgatcttttcgaattttaaatatatagcttctactctgaatgatattgtatctgtgagcgtaatcagaatttgtttctt

SEQ ID NO: 9934 - DNA, 1531 bp, artificial
  synthetic oligonucleotide
tatgtgtttcggtgagaaagggagggcttaatattagactatacagtactatgactttactgccttatggatttattattattccctgaccccacacctgaaactactgctttctttcaaaagctagactactcattcgtagtatcaactggtactttcatttaaattattcactacagttttccaccaaatatcttagttctttatttgattgaaatgaatagatggacactcttgcaagtatgttcttgacaattttgcaactttattaggtaaaatataaccatcttcttttaaatgatcagttatgggaaggagttttaagggaatatttcaaacttaatccataaattacatttaggaatctttccttgcactttacaaatttattgagtttactgaacttgtagcagcacagctaaattccagcaactgcaaaaataattagtgacattaagttgaaaatgttgtaaacaagtgaagttattattcattctgtaccacactacaaatgtgggaggacaagttaaatgataaattaggcatgaactgctttaatctgtaaactgaacatgttagcaaatggcttgcgtttgtaattagtatttatggccacaggagagtgcctctttaaaaacagtgacagaaaattgatcagtttaggtcgtcatagcaaccaaaaagtcccattgcttctgttaggtttaggttattatgctatatactcatgcttagaaatatatttatgaactgtaaagataaacgataaactacttaataatgtaaaagaggttgggatgccgaaatgccaaactgacaaagtccaaatgaataccgaattactcgataacgagcttaagtgttctgcggttgtcatgacatttcttttacaaagcaaatgatgctggaaaaaaaatcttaaaactagactaaaatgcaaatccttttatgacagtatgtggttgtcacgttcataataacagacaataattgatgatttataagatgacaccatggcaacagagtctttcatcattggcaccccttggttacttttatattagacgcttgaggatgcctgtgaaaagtttccaagatgacatacaagaagatctactcttattagctctcgtttaaaacagggtggaagcattgtcgagattttggaatcacctgacaaaataaaagctggcaatgtctctggttaaaaaaaaacatctctgctaaactaatttattcccatgtaagcacattcagtagctaaaattggacagatttgttttggtcacttaacctttcaaagaaagtctgtaatgcctctcaaatttgagtgtaagctgttaggttgtttaaaattatggtgaatgataatatccttatacaggaggcgggagaaggggagagggagtgcaggaaaccttgaccttgcttttaactcctaaaaagatgattttaaaaacagaattttagtgttgaggactttatgaaagtggaataaatttgtaattagatattctaatttatcccattt

SEQ ID NO: 9935 - DNA, 1170 bp, artificial
  synthetic oligonucleotide
attaaacactcaatttgtgtaaataagacattatcatagtgggctatgaaaattggttttatgttcaaatatgtaccaaataatttataatgaaaagtgccagatgtagaataaaaggaaaaatttataaatattctttgaggataagtgttaaatcaatttggggaagaattgatcatgcagaggcattacttatgatttaagagcttaagttgaacaatgagaacacatggacacagggaagggaatatcacatactgtggcctgtcagggggtggaggctaggggagggatagcattaggagaaatacctaatgtaggtgacgagttgataggtgcagcaaaccaccagggcacgtgtatacccatgtaacaaaactgcacgctctgcacatgtaccccagaacttaaagtataataaaaaacttattaaattttaaagaaaaaatagagattaaactattttaaactaaaaacaaaagaagtgtttttaacaacaaataatttgtttcaagctatgtaaacattctgaatataaacattttctttccacctcagacatgaaaaaatagcattctattttgctcttctattgttttatatcacattttttaaacctatgacaaactagtttccatgttaagcctaagttgtgcattgggacagatatttatagaagctgcatgaacagttgaagaccattagaaggctcctggatgcttctcaaaagcaatttataaaagggttaattatacttttgcaagaactttgttgctttaaaatggtatcagacagaatcctttcagttatttaaacacaacctttgcgcacccagtttgtacctggaaccatgttttaggctttatctgtttgctcatttgaatgcttggggattcaaatgtattttactaacttctaagtttgtatgacaaactaatgtagtaaatgacctttaacttagtaaacaacctgaaatattaaaggtaattagaattttcttatttcttctttgtcacctctattttcttagataatgtttatttttacttaagggatgagaggcctgtaacttttcagtttaccaaatctaatggttagcatggcaataattttgtaatgcaaacagctctaaaatgttagtacgtgtgcagactgttgctattaagtaga

SEQ ID NO: 9936 - DNA, 235 bp, artificial
  synthetic oligonucleotide
tgtataatgctatttatatataactgaacccctatgtatttggttataaaggcctctctcgcccagcaaacactagcattgtgccctcttacttagggataggtgtcgatgtggatggagttctaaaaataatttaaaatagaatatgagattagggagtgagtgtgagggtctttaaagaccatcaaatgtccaatatatcaaaagaaggcaaacaactactatttgaagaatt

SEQ ID NO: 9937 - DNA, 554 bp, artificial
  synthetic oligonucleotide
tagtttccattccggttaactttaagaaagagtccgttttttgtattttaaattgtgtataagaaagtacaattaaaagtgttggtattttaaatacattttaatatcattagactgtttgccttagcttgtgtccttcatgaagtagagcctggagcaaaagcacatgtgcagtacttccagagaatggaatattattcagcattaaaaagaaatgaactagcaaggaaatttaaatacatgttaaccagtggaaagaatataatatcaaaagtatacatactgtattctttcaactgtatgacattttagaagaggcaaaactatagagatggcaaaaagatcagtggtttccaagggttggggaagggaggaatgaataggcagagcacagaggaattttaaggcagtaaaactactctatgtgataccatagtgttggatatatgcccttatacatttgtttaaacccatggagtgggagatgttaatactagggagattatgcatgtgtacagacagggagtatatgggaagtctctgcactttctact

SEQ ID NO: 9938 - DNA, 1066 bp, artificial
  synthetic oligonucleotide
agtttttaatagataaaatatttttccttaacaagagagacagtaaaatattcagagtatgtgcatgctattaaaatgcagagactataaggacatcaagaaaaactaaatataaggtcaaaattgagaaataatctacaagattagagattacaagcatttaaatctgttgacctagagaagcatcgaaagataatacagtctttaattatggtagtggaagcagaacaaaaaatgttattatttattttctctcatggcagactaggaagaaaagtgtctccttgttggaagtttaagctagagataaagaaaaagtatctgattgtaatgcctattgacgttgaaacaagataacagtgtgctagccaaatatttgatattgaccttaacatttgggaatatagatagacttttataaagttcagcaatgtactgtgttcctgtaactacccttttttcccctgtacttctagtttatgtgaaaaccagaaacaaacagaaaatcataccagaagacagcactgtacgtcagaagataggagagaaatgcactacctcaattttcactcttttagggtctactttccctcttctccccgattctaaagatggcatttacagcagaactataaaatgttttaaatttattgctccccaaagtattacactggcagtatttcagtacagaatgagagaagggttagaaaaagatactgtgtattaaataaacaaattcttttctaacactgagatttatactgaatgctgcaaagattaacatacatatggagaaattaagggagaatcttaattttatctaattaaactttttattttccttggaaagttggattatgttgaatattattggtttttgatataatgtgcacaaatatatgtatatataaatctaacagaattaaattttataaaatagtagaaaactctattataagatgagtgtcagtcattaatttgaagggtggcattggagggtggcattagagtgaggttccaaatgtaattatatttttcatatggttggtctaggaattttctgtgt

SEQ ID NO: 9939 - DNA, 866 bp, artificial
  synthetic oligonucleotide
attttgcctatttcttaaaaataatgtaatagagtatggttgcaaataattaacaaaagttaaatgagggaatattttccttgttttattttgtgtattaacaatcattatacttaaatatctatatataataccaaaatattaaattcaggatcttaaactgtacccttcagatacagtttaagttcataacatgaggaaaactgtgtcttagtggttgcttggccctttacatttgttttttagctttctctttccagaagtaaatattcccttttcaaaccccatgcctttcactgttactcctagaagggcattcattacatcatgtgtaatgtcatttaatggcttgtttttgaaagcttcagctatttattgctaatgtacttattttgtaagacttctatgttaaaagtcaaaatgtaccttgtgaagtaaaattaaaatgagggaattataataacagcttatttctataaatgtagctctatttttgacatgtttctttaatatggagaacttgtatagaggctattttgtggggagtcatttcaactgatggacactaccaatacccacatttcatttgcaaaacatccagcctaggagttttctataagagggtactaggatggctatatggttagtcatgataatgtcctgtcacagtctacagtttagcgtaaaatttaccaacaccatgactttaaacagagcacaccaaagggaagagccacactatagagaggaccagcaatattgagtgaaagacatagtctgtgtttgctttttgttgagcaaccttactatgtatagcatttttaaggttaattctattctcatggaatattattttcaaaacagat

SEQ ID NO: 9940 - DNA, 729 bp, artificial
  synthetic oligonucleotide
ttgactaaattgaatattaatagcatattagaaggttttttgtttggcatttaaattacaagagaactaatttaaaaatgcaagtacagttatctttcgtttctgactctgaaaaaagcctaatttgcattgtgagaaatggaaaactttgtgtttgtttggtttttgtgtttgttttttattttttatttttggcatttttttcgggctaatcttggttaaattattgttaccataaaggaatgtattacaacaaatgtttataagtatctataactccttatcagtctctaaaaatgagtgaaatatgaacctataatctctggactctattaccaaagtttgttatggaagtaaatgaaggcatgagacactttgaattcctggtatacggagacactataaaaggctcacgggacgttgcagaccattaaaagaatagtaaaaccttacatttttgattacttaatctttggcattttgcaaacatcgttcctaatcctcacaataatgttacaataatgttaccgttactttgcacatcttaagtttagatagccaaccaaaggacaaacattaagaaaggctggagatgaaattcttattcaaatatgatgttcctttttctacactgccactattacagacaaaagaacagcaacaaaactctttggggttttagaatctattggaaaaccagggtaaacacgtagtagcaaaaaaaagaaa

SEQ ID NO: 9941 - DNA, 2871 bp, artificial
  synthetic oligonucleotide
aagctcttgcaatctgctgtacaatattatacctaaagcaacagtaatgtattgtacagttaaaactttgttaagagtgtaaatctcatgttaagtgttcttaacacagaaagtgaataaaataaagttaaaataaaataaataaaagatgctaagtaatgctatataatgttaattaatgtgtatatatgcatacacataatatttttaagaagattaaaatgaactaccaagcacaacaaatttattttattaatttcctctaaagcagggatggtgacagtgggatggatgggattgggcctggggaagagaaaaaaggactccaggttaacaatgattttgcttcgtttatatgcaccggtgggcataaactcagaaaccaaaaagaattaaatggtaacttttagttaattataggtcatagatatttctttgtttgttactttaatctctaattttttctgtatttctgaactatgtttacaatgtggagtctacttttgaaaattaatggcttggattttctgaagtgcaaaacattctactaaaatgcttattaaaattataggctcttgaaagagaaactagaaagtttataggaagtttatttaagggagatgtatccttacaagaaaacagaattgtttgtaaagagggtgagggtggagaactaaacaagctggcattgttaggtaaacactaaaccttcgaaaacttgggagcatcgtaagtcctgctgtcctcaggagcacaatttgcatttttaaaaagtgttcacagtagagaatagaataaagatacagtgataattcatcttgctgaagttcagagtatttttctttccttttctgaagaaggattccaacttctattcattactgttggacacaatacaagacaagtaacagtatgatggaaaagtaaagaggatacttctagaaaaacatcaaatgaaaaacatttttccacttatcagttgtgactatttctttttttatccatgtgtactcccacttgttcctctagtatcagcctcaattctttgccttggtgtccttctgatcacaggttttgcattccctccttcaatatttcctcctcactctccgcatgtcttcccaaatctcttttctctattgctgttgctattacctctaattactctcctttacacttttagtatgcttttattatacttcaacttcgggttctaatcagcattgcctattttgttattttcttctttatctggaaaagttgcatgcatcttccccactcctgcactttctcaaacacaaacttaacccattgttttaaaatttttgtccctttattccctttattttttctcctttttcattctttgcagtattttattttctttttaattttccctatttttttttctttacagcaatcctgagtaaaaaatgcttgtcagcagtttatccttcccacccaattccagaccaccatatcatcttacctgtggtaaaatagctctttcaatctttcatttgactaaatcatcttagttactgctttgcgatctgcctcttctatactaacgcaatttctattttattgattaagaaccactggactgtaagttctatgagggcaaggatatttttcttttttgttcactgctgtacctctagcacctaatgtagtaggtctgggatggggcccagggggctccatttttatatgcttttcaggtgattttgatctttgtggtctatggaacacacttttaggagtatactaaactttatatgatgtggtgtgtgtgcagggatgactcccaatggcgttgtgctcttatttttctttagagatccagagagtggaaaaacctgtgattagttctaaaatttcttattctattggggtaccaatggagactttctgtccccaaattcctcctctctgagagcatctctagtttatatatatatatatgtatatgtatatatatatgtgtgtatatatatgtgtatatatatatgtgtatatatatacgtatacatatatatgtatatatatacgtatatatatgtatatatgtatatatatgtatatatatatgtgtatatatatatgtatatatatatatgtgtatatatatatatatatatatatactacaggagaattctatttcaattagagctccgtccctccccagaatattctattgtgggatacacttccggttgctggaaataagaaggtcttaaaatcaaaccaagtggagattacgttcatttcagagataatttctgccactctacaaatattagagcatcatgattaccctccatgttcaatgcccaagacatatttgaagttgatgtggtttggatctgtgtccccacccaattctcatgtcaaattgtaattcccaatgttggaggtggggcctggtgagacgtcattggatcatgggtgtagtccttcatgaatggttgagcaccatcctcttggtgctgttcttgtgatagtatgtgagtgagttataatgagaactggttgtttaaaactgtgtagcacctccttctacattctctcttgctcctgctcccccttcacattccgccatgattctaagtttcctgaggcctcctcagaagctgagcagaagctgttgtgcctcctgcatagcctgcagaaccatgagccaattaaacctaatttataaattactcagtctcaggtatgtctctatagcaatgtgagaatggactgatacaaaagttatattttgaaaagctaaaacaaaaataaaaataggaaaaaatatatttcaaaaatgcaaacattatcggcattctgacttgtccttattttttttcaccttcatgga

SEQ ID NO: 9942 - DNA, 202 bp, artificial
  synthetic oligonucleotide
gctcaagaaagaaagaagcatccttttccagaacttacgaaagaagttttgaatatctttgccattacattaaaacatttagtaaaaaaagaaaattaggacacattttttaaaattaaatattgtcctaggtatcacaaagaatgatgcctaattttatgcgatgatcttcctcttaagaagcttttctttaatgcagaat

SEQ ID NO: 9943 - DNA, 1175 bp, artificial
  synthetic oligonucleotide
ttactttcttcataatgatttcctttagattacatttgagtctatgctaatgggtctcctagatcacctcaggatgggggctgattacaagaaagaccaaacttgcttagaggatgaaaatttcagcctcaccccttaacctccaaggaaatgtagggatggagattgggttataaaaactctcgaacaagaaaattctgggttggtgaacacattgatataatgggaaggagtcattccaggaaaaggtatggaagctctgtacccccacatcctcatccctttcccttcgcatttcttccagttaactattcctcagtcgtatccttgacaataaacctgtaaatgtaacacacacacacacacagacacacacacactcacacacacaccccataatatatttggcatataatcttagattatgtgtgtgactatatgtaaagacattaaaaaatcatatttctaatcttttttctctttttcacccacctccctgtttataaatttgttcaatgcaataaaaatagttttcactcatagtggattgaaaattataggaaaaatatatctgtctttattaaattaaagcttctaaataatatgttttgcgttattgatgctttatttctaaagtactctgaaaattttaaatttaccaatatacccttaaggttttcttttgttgtaattttcagtttgcatttctaataactgttttattggactttactttctgcattgttacagattacattcagcattttcatgcagatgctatgtcactacatgaagataatgctaaaagatgaaatttgcacatggagagctgtaagaaacagtatatttcttgtaaaagaagaaactgaaattgcagagctctttgactgtcctgtctcttacacctgacagttctgggtatgcctttgcggttagcaacatttttcccctaaaggattgacatttaataacactattctcgcctgtctgacttcagttatctcattagaaaaagatgattcaagaaagctgaatatatttcctccagtgtttaagtttcctaattaaaaataggagtgcagattcaggagagaaaagtactgttgagggagcagttttttactgtttaggattgcttttggccataaataaaacaacatcttatcatatgacat

SEQ ID NO: 9944 - DNA, 1070 bp, artificial
  synthetic oligonucleotide
tagctatatgatgttttaaaaagtaatacatatatcagtataatattaatttcttaattccaagaaatgtgcttcaataaaaagacccctattgttacttacatgtgaaaaaaatatgtacagatttccatgtattatccaagaataaggaaataattatctaaatatttgtttaaatattgtataaaatattgagtattattaaaatatttatatatataaatattcattatatttagtttgacatagctccatatagtcagaatgtctcacatccttccaatcttattaacttaaatgcctcaaaagttaagtgtactttatgattctcctatgtgatccatctattagaacaatctaaattctatttatataagtaaaagcgtgtgtaacatatcatttaatttcaagtctatagtcttaagagtaaagagaggttgggattgtggggttgctcaacagtattctctcattaaacttctcagatgtcaaagtaaagtaaaaggttatgttaaactactcattattcataagtagaatatagttatacactgggaagtgtctttctctaggttagaaagtttaacagcatctgctcccggcttgataatgaacactttgtcaaggccagagaatagtttttatataataacagaagaaaatcactctgcattggtccttgcaaactataatcaacacaaaatagttatagaaatatgacttacctttcatgcttctgtatgtatgatgttttaggggaataaatcttagaagaacataggaatattttgattcccataaagatcttactaaacagtttaactgtatattgttatcagatggaatttctgtgattgctattctataacataattatataccagaacacctggatccaaaaacaattttacatctattacctaactttatgtaatgaaagtgtgcagaaatgagtagtaaaattctgcataatattcctgtttttgattgtcttttgcaatagaccagttccacacaatagcaattgactaaaaaaattgccttagtgtgagcataacctgagtaccatg

SEQ ID NO: 9945 - DNA, 536 bp, artificial
  synthetic oligonucleotide
tatcttactaatgtttatttgcccaagatcagtgcaaagttggataaaaatatttgaagtggagacaccaaaatgcttttgcagactagaggcagtgtataatgctacatgattcactgttctagagcttatccagcagaacagtgaaaggatggtaatgctaacagtgaccaattaaacatatgaaaatattaaatgtacttttaaattgctaatgaagtcatgagtactattcactcccaattttaaaatctccaattttatcatgtaaactagccaaaaaattaagccagatatacaaaacttcagttggcatttcctttagaagactatatatatttcttctatctcatgaagacttttatatttagattgattgtgactgagaatacgaactactaaaaatctaggattcctatctcacaagcctgcatttccaggaggaaagtcctcaatatacatgctgatgcagggtctgggtaagaaaaggatgtggttagactaaagatctggaccaattggagctagatgaacaa

SEQ ID NO: 9946 - DNA, 673 bp, artificial
  synthetic oligonucleotide
tttgctcccagaagaacgattcaatgtattgcttttaatggcttttatagaagataatctgtagaaaaatgaaaaaggccactgtgacataactattgtgatatagtgtctctgattttctatatagtatcagtttgatttccttgaggatatgaaggatctactaagcaggaaacttggcattattaatgtgaggtaattaaattcttaatcaacctaacttccttatttcctagaaacacaaattatgcccaaggatgcaaacaccaggaagctgtcataaaattctgtattgaatttacagaataaatattctaatttctggcaaatcatatatgaataagttttttgtttaagcaaaacaaagaaatacaacgtttgcatttttaaacagaaacgctagtaaaaattgtcaaatattatttaatatccagagaatgtttccaattaacagtcagtaacactccactaagctcccaaatcagtcatcttaaattctataaccagaaaacttagtgcataggaaaaccagcacatgacacaaggcttactatagtgcctttatgacttatatgtatgtttatctaaatttataaaatcttcttcataaataaaatttatgaacttaggaaagatgtacataaattttaactaatttatcctacttaataga

SEQ ID NO: 9947 - DNA, 1519 bp, artificial
  synthetic oligonucleotide
aaaaataaaattttgaaaactattttttctagacattccctcactaccttccataatttatctaactgtatcattaccagaaatcaatgattcattcttttgacaagcccatttcattttttacataattactttaccatatcattataaaaagttactttttatttatttttgagaccgagtctcgctctgtcgcccaggctggagtgcagtggtgcgatctcactgcaatctccgcctccctggttcaagcaattctcctgcctcggcctcctgagtagctgggatcacaggctcccaccaccacacccggctaattttttgtatttttagtagagacagggttttaccttgttggctagcctggtctcgaacccctgacctcaggtgatccgccctcttcaccctcccaaagtgctgggattacaggcgtgagcccccatgcccggccacttttttttttttcttaataggttggcaactttatttgaataaaaggctttcacatttaaatcacatagccttttccagattcaaaaatgtgtgaaatcccctgtgaaacttctgtcttttggagcacgaacgcttaagatggttataaaatataaatatgtgttttatgtatataaacaaaagcataaaactgtattcaaggatagtgtaaaaagttgatagatactaaagaaaacatacaaaaatgaaccctaggtagtaaaaactttgaagaagaaaaaaattgcagcatttccatccataaattgttcattcaccaaaattttttagagactattaaagggcttctggttcaataagcggacttgtgtttaaatctttttatcctaaattagaaatacaataaagaatagagtttcttctgtacaaaaaagggaagacagttttactaacagatcagatacataaaaaaaaaaaatgaaagaattccagagtgccttcatgatcagtggcagatatgacagagatcaataataaaaagtggtgttgaaatctggtgaattgattgaaactgcatatggaacagctgaggcagcctatgactccatagttttctctaaatgtgcagagaactgttagcctagttatccccaggtaaaaaagcatagcatttctttctaaaaaaaattgaactatctggggaaaacaatagcttcatttatgggtgttgaaaattcagaataaaattcttctcattctggctggcatgcaagttttgaggggagagggagtgttggtgaggccacagcctgacatccagcttcccactttctcatagttaattaaaatataagaccttatatactatactcattaaataagctaccagtttgatgtcatgctcatatgaaaaatcagacttaaaaaagaatagagggaaaccataccagctacctagaattttcttctaaatataaacagacaatcacagatcactaggaataaaaaacaaaccttctgcatgaaaataaaagttgaaataattaaaaagtatactcaggcgaaa

SEQ ID NO: 9948 - DNA, 1138 bp, artificial
  synthetic oligonucleotide
gattcatcttgagaaccccagttcacagcaactcagtgtaggtgcacagtcaataatttaaaatacaattcagaatactgatatgatgcaagtaaacagaaaactaacatggaacaatgaaacgatgatgaacataagctcaaggcagagtctgttttccctttcttatactcctataaaaggagaaggattccaattttgataacatgactgtaattagttaacaaaaggatacagggaacagtgtagcctattacaatagaaaaatgcatgccctaaaattaaggcatctcaaagtacatgtctttttattagatagtttgttggtttacaatttaaactttggtggttttaaaatgtaaaccactagaaaaatcttcttgtggtttttaaaagtgaagaaaaataatttgtaaaatggttaagagttaaattagacaagaatgacccagttgcttccaccattttataacattcactgtctatgtacatgctttttaatgtttttttttctcccacattaatcaaatgctaggatatagggcatatcgaggccatagcctacctaagcactaaatgccattcgcacttgttttattttatttcatttttgagacggagtctccttctgtcgcccaggctgggatgccgtaacagaatctcggctcactgcgacctccacctccagggctcaagagattctcctgcttcagactccctagtagctgagattacaggcatgtgccattcccagctaatttgctattcaccttttgattccggagaatcaaaggtgtcctgttgagcagtcttgtgtgaatgagaatcaggtcttgaataaattgctcacaaaatccatgccgaactaatctcccaatggctcccagtgatcacaaggtcttttacacaaatctctgcaatgcttgactgacctcattggcctcctgcacctcagtaaatggatccataggggcatttgccttgtatttaaggaaagaaagaatctttctgaatttggactaaatgccataaaatctctgtcatgtacaaatgcaataattattgcagctgggcctatgggccacttcttattaagaaaaaaatcatttatttgcaagagttctaaaaactcaaagca

SEQ ID NO: 9949 - DNA, 978 bp, artificial
  synthetic oligonucleotide
aagtttatcacatcaaatggttatccattaaaatattatagagtttatcaatgatgtaagtatgatgaattagtgtctatgaaaagggataaatcaacaatttacaaatatatacattttaaaacaagtaaataacatgaggaaatgttaacactttacactcatttgtgtacatttagaaagaaataagtatttgcatttcagaattggtgcagcagcatgtattttggaatcattctcttttttttctcctaccagatggatcctactgctcatatttgaatctgggacagtttagaaacctatctctttttttccatctgactgagatctttccaggagggaagacaaatctatatcaagaacagtaaggaatcttactttctctctttcaaaacaccttggggtaggtgaacagaggagcagttaggtagaaacaaattagttcaggagacaatatttttactatgaattcttaaataaaaggatggaagcttgctcttcactttatgatatatggaatattggaagtcatttccccatgtcttttgatatgttttgtgtatgccactacactagtaaaaaaatatttacatgtaaggcatcctgctacatacgtttttgccctcttaaaggtgttttgccctcttaaagataaaaataataaaggtagatattaatgggaaaaatagagtatactttaaaattgtggataggaattaaaatatcaggttaaatatatgctgtattcattgatatccaagtaacatttaagatgacatagagttttgtactgttatttccagcagtggcagtgagttgaagtagaaagtgcccttgtataaagatgcaaggacataacccttcattgtggctgagtgatatcctaatcatttaggtcttgaaggaacatctttttctaaatgaaaaaaaaataatgttcaccatttctccaatgaatgtattattgttgctcag

SEQ ID NO: 9950 - DNA, 5177 bp, artificial
  synthetic oligonucleotide
aaggttttaaccttcaaaatatcaggaatgggaaaggaggcagctaagaagatggagaaggatatactggggaaacaagtcataaggatttgcctttcagttaaaaaactttccctgaagcagctattagagaaaagcaacttattataattctgaaaatttttccttcttgatgttctatctctatgcagatgtcatctcctcttccattcagtagacaaaaaataaaaaatggatactgtgttattggtgctctgaaacattctctactttttctccttttatttcaggaaaaagagccacctcctttcaaataattgcacagcaccagaaagataagtttttctacaggataagcacggaaagtggattttccccataaaatcgtacacctttctggagagaggaatttagaaaattcacctggttaattttctggcgtctgggtaaatttaaggagttgttccttgaaacaagaataagagttgaccagctggggtggttttgatgttgttactactggttttttaatcacatgccaggaacgggggaattggcccctacttccttatatccacgacccttcgaaggcataaaccagccacattcctcctggtacctttagtggtccttggggacctggcacccggatgcccacccagccgtcgcccaccaggcagccagagctggctggcaagcaccaggcatgaggctccgggctggtttcctccctctcttgccccctttcctaccttggaaaagcgccgtccatgcccgcgacgctgcctggtctctggcagcaatgccacctgactcactcctgcttgctgtctggggtagccaaatgctaggtcgctagaacttctccttccctccttcacacacacacacacacacacacacacacacacacacacacagcccttcgctgctgtcagaggattaatctggaaaggcgatcgaagtaccagaccccgctcacagttgagtatgatatatgcggacagcctctcagctccaactgtgactttgccaggcttctgcccctactacccctagtctgccttaagtatcctttgtatgagaaaatggtgctgtgggatgcttgttctctagctggagtcggcagccagcggtatcacaagaaaaacacacaagaaaaatcaaacttctctgagaaaatgtgaatgggtgaaacttaaagggaagcctaagagaagagtgagcagaggaccgaggagaacattgtatgcccagggttttgctcaggaaagctagcagcccgaaagcggcgcgttttcttcagcagcgggtcccgcacgcgagagtgctgccagcacgctttctgcctccttctccaggaggcgagcagtaacttcctaagcttacctccatctctcccccgcccttcttgctggttctccgtcagcggggaggggccgcccccggatcgatgggggatgtgaggtgcagggagtggggaccagaggggggtactcagcagttggtgctgcgccatcccttcccagcaggcggcccggacactggttcacttctctccccacgccttcccctggttcaccccccttccttcccctttctccccctcggttaagtccctccccctcgccattcaaaagggctggctcggcactggctccttgcagtcggcgaactgtcggggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggtaagtaaccggactgggtacctgtacagggtgctgtcagggaggcgtgaggtccacacttagtgcgcggacactgcccgctgcctgcccctgaggtctgaactatgacaacggggtggttttaaagacgcttctgctattctcccttcccccttctcttcccgggaggtaagagaaagagcaaaccccggaggtgagcgcagggagaatatctttttgcactaccaccgctgcgcttggttactttgggaaaactctcacttttgtcagaaatgtgtcggcgcatgaatttccccgacattggctgtgcaaaaaggtctctccctttaatgggtacagccagcttcagcgaggctgagggaaactctaagattggggcgggtgttgacaaaagagcacgtcccggactcccagactcgcccggctgagagattggagctgaggggcgatgcctctagctgagaaactacccctggcctccctgcgctcctctgggggctcgggtttggatccctgccaggctggctccaacccttgagggtacgacccttggcgcagagaggagagccaggagagccaggagcgcacagggttcccggtgctgtttctcttggcgctcgcctccccgcccttccttcccgccctatttttatggggctgtactcagccagcacctgctggatgtggagatggtaggtgtgagaaatactgcctattttttaaaaatcaacttataatctagccgaaaaacggcatcattttctcatttaaaaaaaatgacttttctaagagtattgccagacataaaagggttcctctttctctaaagaaatgacttgtaatcccttagccaaataaataaatcaataaaccgcccacctatcccataaataggtggtgttttctaagacagaacccagaaacagttcacgtcctcacaaaggaattctttttcttaaagcgcgtagcgataaaacggctcttttttttcgagaaaagtaatgtaccttttaaaagaggttcatcggaaaatgtgactttttaaaagcgagcagccgcaaacgggtgtattttttagactttagaagagcggagcggcagtccgcccgggttgcggctgggactcgcatctgagcgcttagtcgcaaaaggactgaggggtaggaggagaggtcactttctcagagtgtatagccagagccgcttccttgcctctcccagggaaagacttttagagcttaaccgaagatgggcccttttgcttcagaatgatttattccgcgttcctctgcttcacccgcctgcggcttagggtgtggggcgctaggctgctcatgtgaagcgcttacgggtgagccctagcctctccgatgcaaaatgtgggctgggggctgggaattgctatttgcgccactgcggcacacacccacaaagcaaaaaccgtggggaagaggggctaggacaaaagaaaaagaattaaagctcagcaacaaacaaaataaaaatttttaaagtgtccttttcttgtgtggaaacatcacaaaatgggatttaaacccagcctaggatctgtttgtacgaagaaaagtgtgtggaagaaactggttgaaaatccgggtagaagggggagggggggcagcaaagatggggaggaggcgatggtgtcatagcagtcgcctgtgcgctcttagcgctgcaaccaggaaacaacctgaggagcatgcagagaattccgaacgctgagcacacctgagaacatagaggtgctttgtgacttaaagcgacctaggccccctaaaaagtaaaacaggtgtgactcaaaatagaaaaggaaacggtacttgcgggcacccgcgcaacttggtaaagactgacggaattccacttttaatcttgtttgaaacaaactctcgcaatcccagcaggaaattccagcgccagggctggcctttcctctgtgggtctgtgtgtgtgtgtgtgcgcgtgtgtgtgtgtgtgtgtcgcggcggggctgggggtggggaagcaattcgaagcaagtcgaagtaatagtgtatgtacacgtttccccctttcttgcctttgtctggttcatcatagagagagcgcggaccgtgtgcgggcggtcttgacgaaagaaccgagagatggatgcgctaaggtctaaagatacctttctccctcgactaaattaagaattgccgcgacagttcccaaaagctgagtcccgctgcagctgccaggtcgccacactcgccaagcggcgagggagcgcctttgcctaccaggccggagaaccctgttcttcagtcgccttggcaggggcagcccctccttctggcaatgatgtcagctgcagagaggcttggcccggccgatgggaagccgagcggcgagtccgacccgcaagcacgagcagccctgccccgcgcgctccctgcgcgcagccgccctcgtgtcccttcggcctctcctgggtcccggctcgcagccccccccttccagtccctcgctcctcagaggcgcgctaaggcgccagaggcgggggtggccactgctggcggcccgccgccggttttaaacccggggttcaaacccagatttggggtcttccctcctccatttcctcctttcctccgcgccccagctctctccctttttcagcctgcaccttcactattcacagtgactttacttatttagcaacattttagagggcaagtgttccagatgcaataatagtagtaactggtgttaaatttctgctgttttctctcccctcgggtgataaaaaagatgtgaagaacggcctctttaaaaaaaaaccccgtggctgctgcttcgcctgtcacagagcaagctctctagaaggcggggagggtcatctttcccacaaaattgtgaggtgggggagggtttgtaaccttaggcgaaagcgcaggctggggaatccccttcacagaaagaagaaactgcaaattggaagttgcggaaaggctctatccactactgccataggggagagaccaccatgctctttatttagagacacgcgctccaaattgggatgatgcaggaataggtttctttaagacggaagcccgctgcggcttcccttttgagcttgctcttatagtcctaaggagcaagcccctgctttgccaaatttgaggctaatctgttttcctgattgcggacaattcc

SEQ ID NO: 9951 - DNA, 301 bp, artificial
  synthetic oligonucleotide
ggaaatgaaggtatagtaagacttcggtaaaattaattgcattggaagagatgcctgaactctccttgtgattgcaattatttatctgagtgggcatgggagagacagagaaattggtagtaaaagataaagagaaaaaattccgtgtaaggaaatatgttagccgctagcccaaacattctttcaatgacagcaggtttatggtctctaaaaaaggtcttgcatcgttttacttgaattctttttataacattttgcatgtctctgagagaaaaccaatgagagaccacagcaatttttt

SEQ ID NO: 9952 - DNA, 1838 bp, artificial
  synthetic oligonucleotide
ctttaaaagcttcacttgaaatgccacaggaatttaatggattagccaaatcacaggcttgtagatattttcaggcaacgtgctgagttgtttgaaaagtaaagctcccctaatctcccaagtttaactttcttctatttctacaacacctccaatgcatacattaattcagtgtgcaatatagtagggaacattgtttcaagaatgagatccagattcaacatgcgaaacatttgtcaattttatacgttaacccttgtatacttgatcataaaaccatttctagttctgtaactcaaactgtcaaataatgaactagataacatattcagtgcctccttcatacaaggatatatcagcacaaataaacatacataaatacatttcccagaatactataagcatacccacatgcgacatttaagaccaagctcatctagctcttgagagataatttattttatgttggagtgcgagaagagaaaacatagatacatagagatactacaatgtctctacctaggtttacagcttctgtcatgttctttaatgttctctaggctccacactacagatccttagaacagattggcacactttttgcgggtgttgggagtggggagcaaagatcttacagtaactagcagatattttaagcattaaagtacaacgtagtttttttttttcttttttttttggttgttgtttttttttgagatggagtcttgctttgttgcccacgctagagtgcagtggggcaatctcggctcactgcaacctctgcctcccgggttcaagcgattctcctgcctcaacctcccaagtaggtggaattatataagcatgcaccaccacgcccagctaatttttgtatttttagtagagatgaggtattgccatgctggacaggctggtcttgaactcctgacctcaagcaatctgcctgccttggcttcccaaagtgctaggattacaggattgagccactgtgcccggccacaaggtagttattcttatttcaaactagtttgaggcatggtgctctatgcttaaatgtctttggagaagttcttgtaccagcaataaacctagccattagagagtggaggttaaaagctcagcaaatagtgatgtattctgattttatcacaaaagcttctgtgggactagaatcaggaattggaatgacctctaacactctcatccttgagatggcctgtttcttaacagacaataaaagttacaattgcatgatggggcgatttttaagtttgccataatttagccaaacaaatttttccctctggggccggcctgtataaattttggaaacatattttgaagtactgaaacatgtgcaaacctaatagtcattttgtgagttaaatctgtgaattttggtgcaatattcagacaaaacctagaacatcttaggtgaaccaactttttggtacatgtttttagttggtatataaggattgtatattatcacagtcacttgaggattcttatttatggatacatatatactatatgtacacaattatacatacaatttggaaaattatatattaatgataaattatattatatatacatatacacacacacaaacacaatttggaaaatgttctatatttggtagtacagaagagtttttgttttgctttgatttccagccaccattaccattacccactttttacccatgaatttccttccatggagtctttgtttcagagaaggattagaagccttggataaatgaattgtgagagcaattctgttgctttctctttccttggttttaaagataactcaccagtacagaaactaaa

SEQ ID NO: 9953 - DNA, 3209 bp, artificial
  synthetic oligonucleotide
aattaagcacaaatagcatcttcgaagaactcagaagacatacaggacagcaacctcccagaacagatttctcagggacaagaaatctagtgagagtttgtttctacctagaatcttgatctaagtgaatacataaattttctaaaatgttaacatttcttcatcaaataactcaaggttaggaagaagtgcctttttatggcttatgatatggatcttgatatgagtcataatttttttaatgaaggagaaccattctgtctccttgccccacacttgagcttaatgttctaatattaggaaacaaaaaggttgataattctttactttgtgaattataattgactttttaaaaagaaagttaactcataattgtaatagccgctaactctctgacaaaccttttgcacataactggaaagcataaaagacaaaaactataagttcatgatttcattctctttttatttttttatgtttaaatttatttgtttgtttgtttatttttgagatggagtctcgctctgtccccaggctgcagtgcagtggtgtgatctcggctcactgcaacctctgcctcctgggttcaagcgattctcctgcctcagcctcccgagtagctgggactgcaggcgtgcgccaacacgcccagctaatttttttttttgtatttttagtagagatggggttttaccatgttggctaggatggtcttgatctcttgacctcatgatccgcccacctcggcctcctaaagtgctgggattacaggcgtgagccactgcacccggcctccattctctttttaaacaattagtgccattattcagatattggaatggtggcaagctagagtagacccgggttatacaacttttgtggtggttgttgttgttttgttttgagagggagtttctctgtgttgcccaggctggagtgcagtggtgctgttttggctcactgcaacctctgtctcccagattcaagcaattcttctgcctcagcctcccgagtaactgggattacaggcatgtgccaccacgtccaactaatttttgtatttttagtaaagacgaggtttcaccatgttggccaggctggtctcgaacccctgatctcaagtgatccacctgcctctgcctcccaaagtgctgagattacaggtgtgagccaccatgcctggcccccaggttatacaattataattcatttatagttatgggcagacttgtttaacatttaggaattatcaatccagtcttctgtatgtaattaaaggggatttttttttaatttgacatagttattaaaaagacttcctgcaagcaaaattacatattgaaggtagtgaaaaagacattattttatgtgtttgtgttctagtgaatctgaaagattaatccattttaaccctagggtggggtgtagtagtggtgaatcatctcagtattattgatacacatcagattattttcatgatggcatccactttacatgcagtaaagtatgtataacttttgttttttggtggggacaagaatgatgccaataacctaaactatctttactatatcgtgcttttctttgtaggggctagttaaatctttaggagtttaacttcacctatagtatatttatctccattaataacaagaacattataattttttactaattatgacaaaatttagtattttgagcataaatttggccaaactattcctctatatttttttccaatttcaaaataatacttttatattttaaataatatattgctttaacataataaattactgtatattttcccattaaagagatttatgcatgaaatatttccaagtgaaagatacacttttaagtgtgtgataaacccatgaattatttctactctcacacctcttaaaaaattttaaaataaatgtttatctaaaaatcactctacagtaagctgctgaataatcaattgatttcagccttttgagcttttcaaattcttactggaaaaaactactttgatggaatggttttcccttcccttaatcctgctctgacaacttacaaaatattggaaaatgcacaactgctatatctgaatcatacgtttagaaaaaattttaatgcattcatagccatctttaaaaaattggacaacattcaagagactcgcccaggtactacttacatagtatatttttaggaacttatggtaacagcagtgacagtaagtactttgaaaataaggactaaatgaagcttatagtattgtgttttgtctttatttgggtctagttcttaagaaaataattggggatcattagtttgaaatatctgtgcctacattgaggagtaatcttgagcgattctcagagaggtgaaaataagaaataatccaatgaataagcaaacgtaaattattcttttagggatttaaacataatttactgatattttctgataagttttgatatttaaaatatgaaagttcagattacctaatgttaaattagctgatggattgaacttgtctactcataattcataactcttccactgaatatttgaagcccataaatccaatacaacttcatttttatggcacctatcttaattagctttcagtcaggatattgaaatatgaaaatatacgcagaattatagttctgtgctgtttttgttctttcacatgctaataagagtatgcatttttaaagtttagtaaacttaaattataaaaagtgggaaaatgtcttctccttgaaataaaattgataagctaagactacatatatatcatctgagaaataaatattatgttttttttttttttccagtaatgtctggaacagctagaatctctcccaggtgccctagggcaggccatctcatagagatatatgatcactgggtcttgctatctagatctggaggcttgtcaggatcagagttctgcacagaaacattaagagattttgcactgtgaatatttcaacatgtccagataatctgtgtgaaaagcattgttcttttgtgcttctctggatgacctctttgcacagagtgatagctttatccttttttcacatcattatgtttgctggggggaaatcatgctgtgctatgtcataataatatgtaatcttcttgctcagtttagctgagatttaaggagactctgttcacagaagcccttctttaaaacctgatgt

SEQ ID NO: 9954 - DNA, 1806 bp, artificial
  synthetic oligonucleotide
aatgggaatgaaatgggataactttacacagtttcaattttttttccaggctttaataacatacttattaccaatccaggaaaattaattctgttaaaaatacaattcaataaatcagtgttccagagagcagttttaggtcatgatctaagcctatataatatattctgtatttctttattaaaatcatcttaagagcaatgattatgtggttctgctttaagctggtgagttaaggtgagattggcatagggagagactctcttggcttataaatggtggaggcattacaaaaatcctctcatatccttttttatgatgagtaggagtgtgctatttctagtacagttaggattttgacaagttatgctcaagtaattgatgtttgccctaccctgttggctagactgctcaggtcatgcttgaggccaccccaggaatcatggtcttctgtgtaaacctgacaacctgttgctggaaggcaataagttaatttgatggtgtccaaagtacttataaatcaatttggcaatctctttcttccacgtcaatagagggaacaatctgacttaatagatcagatacatttaccttcacttatagctttagagtgtcacagcaatctgtagagttattgagataacttggtgacatccttctagttttcttcaaatgccttcaggtaacaagaagatagacaatcctaaataatgtttatataaaatttattgcagagttaagctcctaatatagaaaagatagcaatgtagtacatgataacactatttatcaccatcactttgagtgccatcattaagatactgcaattcttctcttaaaaaacttttattttcaggggtacatgtgcagttttgttatacaggtaaattatgtgtcatgagggtttgatgtacagattattttgtcactcaggtaataagcatggtacccgataagcagtttttttattttcatccttctcccaccagccacccttaaatgggcctcattgtctcttgtctcttctttgtgtctatatgtactcaatgtttagctttcacttgtaaatgagaacatgagatatttggttttctgttcctgtgttaattcgtttaggataatggtctctagcttcatccttgttgctgcaaaggacacgatctctttctttttatggttgcatggtagtccatgcattttcttatccagtctgccattgataggcacctaagttgactctgtgtttttgctattgtgaatagtgctgcaatgaacatacaacatactgcaattacttggaacaaaaagataactcgttgagaaggatagaaactgaacaatcgacatatttggagatggtcttgtacactcctaaacttggcaacattctatgcccaagaattctagaagcaatgactcttacccttattcaccttatattctctgatctgcaatcatataaatgaaaacaggaaggaaatgatagaaacagccaaaaactcttgcttttttccagacattatatatacattttaaaaagaagtattataactttaagtgacaatcaaacataatattaagatagtccctctacgtgaaatcattctaatatcaagggaaacagcaatttaacaagtaaattttaggaaatgcagcgttctaatttaggtaccaaaacttattttaaatgacattttcagccaaatgagagaaaaagaaactcaccatttttttctcatattattctaatttcatccctgtgcagtatagaagccagattgtcactgtgccctgggaagctttgca

SEQ ID NO: 9955 - DNA, 854 bp, artificial
  synthetic oligonucleotide
tagagacaaaaatatgatcttggacaaacaataatattttattccacctctgttagtttcttttattttcttttagcatctagaatttgagatctgtaggttctcatatttatctattataaattcttctcataaggaacttgcttataggaagtttctatttcaggctatataatctcaataaggcaaggacatttatggtttcatcaattctcactaatctgcagtccttcagccttacaatctgattcttgtgaaaagctgtcatcagaaggcagtatctatagtgtacattttccctgtaaattaattgtgacacattgagtggcggttcctcatgcctgggggaggcgtggctattttttcatctaatttcatttatgtttttttttgtgccaaactgccttttgttagaaaaaatatatatattcaacttgattaatttgggggaggataaacatgcattattttgtgtatgagttatcttcatattttggagtgtgcagaagtgattggctatttttgatgaccactaatacagtaaaatttggtatctcattatttaaatttattgatcagaaggaaagaaagagcactgtgagaactgactgtaatgaaaagtctataaggtactaccttagcttaaaacatctaaatagatttctcacaacaattaagggtaaatatgtcccttggtacatgcacacaatgaacagcttggattgttgtatttaatttcttacacagtatgataaaagcaaactagtggaatttaaactttagtttaaagcaaagttcatgtctctatgataaaattcagtgaatcaaaagccagtgttttcagccgacctaat

SEQ ID NO: 9956 - DNA, 355 bp, artificial
  synthetic oligonucleotide
tattaattttcacctagatcttcacctttaaagttttcaaaactcctattttgtttcaaaacatcatgagttgtttcatgtgtcattactgtgtgttctgagtatctgtttatacgtgtgtactgggatatgtgtccgggcatttacgtttttttttgtttttttttttttttttttttgtagaatgtgaatctgcaagtcattttatgcatatctcctgggggtttaaaaataaatctcttctttctgctaagtcaagttgtaaatatctcgtttagtctgctactacagtaactcatgaaaagagaaagattgcttttcaatattttacctctgtcctcattttatgtcagtg

SEQ ID NO: 9957 - DNA, 6224 bp, artificial
  synthetic oligonucleotide
ttctcagggtactttctctttccaggtagtttctcttccccatttctttctctttcccaggaagagaaagtcaggaggttaactttaaagttttggtggtgtggacaacagcagagaacagtgatgcttctgtatgccccaaaatagaaaagaataaaacattggtgaacagttgtaatatatacaatgctacatgccaagtaccaagctaagtcttttcacatattaatttatttaacccttacaaaaaaatgagtcagacactattattagccctgttttataggcacagaaacacacatggtgaggttaaataacttgtcccatgtcaaatgcctagtaaatggtataattagaatataaaccccagggattctggctcaagaattctatatcataagtgttctgctatgccaatacacatgacaactcttatgcttattcaccaggtagaagaaataaatataagaaactattttgtcttgtcttgtactttgagtgagcatggtgtgtttggggaacagaaaaggagaatggcatctctgaaacaagggtattgtcttgggaaatgtatttgtctgtctcgcattgctacagactacctgagactgggtaacttatgaagaaaagaggcttaattgactcacagttctgcaggctgtacaggaagcatgacttgggaggcctcaggaaacttgcaatcatggtggaaggtgaaggggaggcagacacaccttcatatggaagaggaggagacagagagaagagggaagtgctacacactcttaaaacaaccaaatctcgtgagaactcactatcttgagaacagcaagggggaagtccgcccctgtgatccaatcacctctcaccagtcccctcctccaacatggaggattacaattagacatgagatttggatgggaccacagagcgaaatcatatcattccacatttggaccctcccagatctcatgtctttctcacattgcaaaatacaatcatgccttctcaacagtccctcaatgtcttaattcattttagcattcattcaaaagcccaagtccaaagtctcatctgagacaaggcaagtcccttttgcctatgagcttgtaaaatcacaaacaagctatttacttccaagacacaatgggtgtataggtattgggtaaatgctcctgttccaaaaaagagaaattggccaaaacaaagggccccatgcagttcaaaacagcagggcagtcattatatcttaaaactccaaaataatctcctttgactccatgtctcacatccagggcacatcaatgcaaggggtggactcccaaggccttgggcatctctgctcctttggctctgcagggtacagcccccttggttgttttcactggctggagtagagtgcctgtggattgtccaggtacatggtgcaagctgttggtggatctaccattttgggttctgaaggatggtggccctcttcttgcagcttcattgggcagtgctccagtggagacactgtgtgggggctccaactccatatttaccctttgcattgcactagtagaggttctccatgagggctctgcccctgcaccagacttctgcttgaacatccaggtgtttccatacatcctctaaaatcttgatgaaggctcctaagcttcaacttttgccctctgtggacccacaggcttaacactatgtggaaaccaccaaggtttgtggcttgcttcctctgaaacagccgtctgagatgtatttgaggcccttttagccacagctggagctggagcagctgcgatatagggagcagtatcccgaggttacacagggcagccgggctcttggcccacaaaaccattcttcctttcaaggcctctaggcctgtgattagaggggctaccacaagtctctgaaacaccttcaaggcattttccccattgtcttagctattaacattcagctcctatttacttatgcaaatttctgcagccagcttgaattcctccccagaaaatgaaattctcttttctaccaatcgtcaggctgcaaattttctaaacttttatgctctgcttcccttttaaatataagttatagtttcagatcatctctttgctcccacatatgaccatatgctgaaatttcttctgccagataacctaaatcatcactctcaagtacaaagttccacagacctctagattgagatacatccccagttttttttgctaaatcatagcaagaatgacctatactccagttcccaataagtttcttatctccatctgagaccacctcagcctgcacttcattgtccatatcactagtgcattttggtcacaacaatttaacaagcctctaagaagttccaaactttccctcatcttcatgtctttttctgagccctctatattgttccagcttctgcccattacctagttccaaagttgctttcacattttcaggtatctttatagcaatgccctacttctctggtaccaattttctgtattagtcctttcttgcattgctataaagaattacctgggtaatttatgtagaaaacagttttaattgactcacagttctgcaggctgtacaggaagcatggcttgggaggcctcaggaaacttacaatcatggaagaaagcgaaggggaagtaggctcatcttcacatggcagagcaggggagagagagagaagggggaagtgctacacacttttaaacaaccagatctcatgagaactcagtcactaacagcagaagagcaaggaggagatccacccctatgatgcaatcttctaccaggtctctcctccaacactgaggattgcaatttgacatgagatttgagtgggaacacagagccaaactgcattcagaaaataacagaaactagagttatctaatatcatattcatctgaaaataattcagaacagtgctggagtggacatggagaacctatatatcttgctggcctttcacaagcagtgctgcaagagctgtatactgtagcctgcccaaaccaaatatgggtacatgttcacatacctaatgctttaacgtactgaagccacaaagacataattagaagtaagtatctttgtgctcagggcagttgatcaattaataaatatttattgagccctctatgtggcagtcacagttctagtgaccaagttagagacactgtgctagtgacaccacagcaaaccccaaataaagaaccagtcccttcaatttataatctagccattatactctgatatcagttgcagttatttaataacaaaaaattactttgggtaatttaagctaaacataagtttttttaaaaaaaaaagagagagagagagaagaggagctcacaaaatcaacaggaaactgaaaatgtagttatggaaagaattgggaacaaaggtagatcttgagagcttggaagcaaactgcagaaacaacctaatcagcgcctcaccactgttaggagtgaagaaatgtcaactgacttacttttctgttatcctgtattcaaaattcaggttccaggaagaaacttttaacttgtctagcttggtttatatggccaccctttagttagaaaaagtgcggcccaattagagtaccatcagatggtattcagtaaagaagagattatttctcaaaatgaaattggggtgcttttacaaagagaatggatcctgggtactcaaaaatcaactataaaacgtgttaaatttcagatctttgacacatttttttccatcatacactgttaatagtaaagaaaactaaacatctatctctaggaatctaactagtgtagcctaaaatagtaagccatatcacactactatgtcacagggctagagtaaccaaaacagcatggtactggttaaaaaaaaaaaaaaaagaaaagaaaaaaacagacacacagaacaatggaatggaatggagagcccagaaataaggccacacacctataaccatctgctcttcagcaaagttgacaaaaacaagcaatggggaaaggaatccccattcaataaattgtgcttggataactggctagccatatgcagaagactgaaactggaccttttctttttatcatatataaaaatcaatccaagattaattaaagatttaaatgttgtattattcagggttctggagagggacagaatagaatatgtgtatatatgaaatggagcttattagggagaattggctcacacaatcataaggcgaagtcccacgataggccatctgcaagctggggaagagagaagccgccagtggctcagtctgagtttgaaagcatcaaaaccagggaagccaacagtgcaaccttcaatctgtggccaaaagcctgagagcctctggccattcactggtgcaagtaccagagtttaaaggccaaagaacctggagtctgatgtccaatggcagaaagagtgaaagcaagcatccagtatgggaagattaaagaaaccgaagactcagcaagcaaagctattccaccttcttccacctgctttgttctagctgtgctggcagctgattggatggtgcccacccacactgaagatgagtctgcctctcccagtgcactgactctaacgtcaatctcctcttggaatgccctcaaagacacacccagaaacaatactttaccagccatctaggcaacccttaatccagttaagttgacatctaatattaactatcacaagttgaaactgtaccccttcctttcaccatataaaaaaatcaactccagattgattaaatatttaaatgtaaaacctaaaaatataaaaaaaacctagaagaaaacctaggaaatatggttctggacataggccttggcaaagatttcatgatgaagactccaaaagcaattgcaagaaaaacaaaaattgacaagtgggacctaatttaactaaagagcttctgcacagcaaaagaaaatatcaacagagtaatcaaattacagaatgggataaaatatttgcaagctatgcatctgacaaagctctaatgttcaggatctattagaaatgtaaaataaccagcaaagtacaagtaatcccactaaaaatcgcaaatgacatgaacagacacttctgaaatgaagacatacacatgaacaacaaacatgagaaagaatactcaatatcactaataattaaagaaatacagatcaaaaccacaataagacaacatctcacactagtcagaatggctattattaaaaagtaaaaaaataacagatgctggtaacattgaagagaaaagggaatgcttatacactgatggtgggaaggtaaattagttcagccactgtggaaagcagtttggagatttctcaaagaacttaaagcagggttgccatgtgactgagcaatcccattactgggtacacacccaaaggaatataaattgttttaccataaagactcatgaacacatatgttcattgcagcacttctcacaatagcaaagacaagtaatcaacctagatgcccatgagtggtgggctggataaagaaaatgtggtacatatatactatggaatactacacagctataaagaagaataagattatgtcctttgcagcaatatgaatgtggctggaggccattatcctaagcgaattaatgcagtaacagaaaaccaaataccacatattctcacttctaagtgggagctattgagtatacatggacacaaaaaaaggaacaacaggcaccggggcctacttgagggtagagggtagaggagtgagggttgaagaactacctatcaggtaccatgagcattacctgagtagttagataatctgtacaccaaactcctgcaacatgcaatttactcatgtaacaaacctgcacatgttctccctggagctaaaataaaagttgggaggaaaaaataaacataaaaataaaaaaagccattcaaaaaaaatgaacatgcacacacacacacacacacacacacaaatacatgcacacacacacagacaccacttatatttaaaacttgtatatattttccattctacttaataaactatatacctctatttaatataaacttgaggaagacaagcaaacaagaaactacggtgcttgtaccaacatctaaagctcattgagctcttaatctggagcctattttatatatactgtctcataatatacataattccat

SEQ ID NO: 9958 - DNA, 1764 bp, artificial
  synthetic oligonucleotide
cctttcctcaggaactcttttatgagtctctcttactgcagcccttgccttagcctctgttgctttaggctgttctttatcatctgcctttacctgggggacttctttaggatcttcttttacttcaggggttgcctccatacagtctttagaatctgctttttcttcagcctttacctcaggaatttctttaggaacttccttttcttcatccttcacctcaggaatttctttaggaacttccttctcttcagctttcacctctgggttttctttagggttttcttcttcctcaccctctaagggaggcatttcactaggggtgttatcctgcacctcctcatcactgctgaactcctcatcctctgaattccattcacattcttcttctgtaggctcgtattctgcattgatgatttgaaaccgcctatcatacagaggcttgttgagttcagcatattttctttcaagatcatgaattgcttttaagaacagggtatctaccttgtcacattcatcttgaatgtttctaagcgcttgcacacgatttctaactgcctgaggcagcctatccacgaaatttgttcccaacggggcccgccgcgcccttctggaaggctcaggtaccctcttctttctatacaagcggctgcggctgctagtgctgccgctgctgctgctgctgctgccgctgccgctgctgctgccactagtgctgctgctgctgctgctgtcactagtgctgctgctagagctactgctgtcagattcttccccagaatcactagtcgagctagccatctcctcttcggcaaccccatgggcgacaggttccgagaccattttaaaatctgcttctgccatcttgcaagcctacaaactctaccagggagaccgcgcgaccagagatgggcagaaaatgactcacggatgcttgagtggcggcggcggaggcccgggctgcggaggtggcagcggcgatggcagcagcggcgcagagcggagctggagctggggatgcagaggccggcgctgaggtggcagcggcagtggaggcttgggcgacagcggtggcggcaaggcctctcccggctgcagctagagtgccgagatgtaccgcagccgaatggcgcagtatgagaccccgagatctcttctcgttttagatcgcgagccccctccccttgcagtcagacctcccgttaatttcgttcccagtgtgcctttagttcgctcctcatttgctggtccaccttaattgacaaactgtacgcccaacgaacggccaaacgccactactcctggctccgcccaccttcccagacgccgctcgctggctgaggtgcgaccccttggaaggtgtccccctgccccccaaaaagtctatatttatagttttataattaaaaaagaaaaaaaagcgtagacatgaggtaaaaataccagccatagttcctaacaagggcaaaagaggcgtgtcttccttctcccatccgcccaccctgaattcccgtttagtttgtcacgggtctcttgacaaaaagctgtaaaaaaaaaaaaaaaaaaaaaaaaaaattgaatgaaaatggtccaaatggcgtcattgggtagtgtgactatggacgatttaaaaacaaaacgattttctctaaatattctatgagcatgcatttttacactggataaaaaaggggagagtcggttattggcagaggagggagggactagacagcaggcgtattgcattccacgaagctgatttaa

SEQ ID NO: 9959 - DNA, 2912 bp, artificial
  synthetic oligonucleotide
tagtgcacaagagtctagaaaattcagtatgcatgggaatatctaaactgggaattatttaattatttgccaaagatgtccaaagattgcaaatttttatatttttataagttgaaatttgagcaaaaacttaagtatcagaatgttttatttttattgtacatacattaccagaaactgtaagcaggctttcataatttacagccattttcattaaaatctgttcatcaatttcaacaaattttctgttaattttccaataattaaaaaaaactgtggcacctaaaataatctcagctacttgtatgatcttgatgatagtaatgcccaatttattcattatttattttcaaggcaattaaaagtgtcctacaaatacatctagttggaaagtgagatcatttcaaatgtccaaatgaaatatgaacaattttggtgactgaggatcatcagaggcatgcaatttgacaaggtcaaatatctttgaactttcatagttcacagcagctttactcatagctctatttattatgtgatcatgtgcatgtgccaaacttatgtaacaatttcttctcctaaagatattgtaatacttttctttggaatcagttttttgggtattttaacagatgagtttgttctggaggcactaattaagtaatcagattggctgagtaaggatttgataattggatataaccatgtaaatttcaaatctcagaatttctattttaaattgcagaaatttagtagacatggatatacagtcatatgtcacttcacaacagggatacattctgagaaacgcattgttaggcgattttgatattgtgcaaccatcatagagtgtattaggttggtacaaaagtcatcaaggtttttgccgttattgcactaacctaaattcttacataaacctaaaagctatagcctactgcacacctaggctatatggtataacctttattcctaccctataagcctgtaaagcatgtgaccgtactgaatactataggcaattgtaacacaacgtatctgtgtatctaaatatatctaaacctagagagggtgcagcaaaagtatggtataagaggtaaaaatatggtacgtctgtataaggtatgaatggatttttcaggacaggaagtcactctgggtgaataagtgagtgggtgagtgaatgtgaaaaccgaggacattattctaaactactgtgggcttaaacattgtacacataggctgctgtgaatttattttaaaaatcttgcttcaataataaattcacctttgattagtgtaagttttatactttataaagtttttaattttaagaaaccttttgacagttttgtaataacactcagcttaaaacacaaacacattgtacaactgaacaaaaatattttctttatgtccttatttaatattttttcagtttaaaaaaattgttttacttactttaaaaacttttttcttaaaaactaagtcacaaacacaaacattagcctaagcctacccagcgtctggatcatcagtatcactgtcacccacctccacatcttgtcccattggaaggtctctaggggcagtaacattcatggagctgtcatctcctataataacaattccttcttaggaaatgtctcctgaaggacaggcaaaggctgttttacagttaactttctgtgagtagaaggaggatactctaaaataatgatgaaaatatagtatagtaaatacataaaccaggaacattgttacttattatcaagtattatgtactgtacataatcatatgtcctatacttgtgtatgactggcagcacagaagttttgtttacaccaacatcaccaccaacatgtgagtaatgtgttgtactatgaagttaggacaactatgatgtcactaggtgattcagagtttcatttccattataatctcatgggacaataatttatatgcagtctttccttgaccaaaatgtctttatgcatcacatgactgtatctgaaatgatagttattttaaatatttataaatgatatcttggactggacgtggtggctcacgcctgtaatcccagcactttgggaggccgaggcgggcggatcacgaggtcaggagatcgagaccatcctgtctaacacagtgaaaccccgtctctactaaaaatacacataaaaaaaaattagccgggcatggtggtgggcacctgtagtcccagctactctggaggctgaggctggagaatggcgtgaacccgggaggcggagcttgcagtgagctgagatcgtgccactgcactccagcttgggcgacagagtgggactacgtctcaaaaaaaaaaaaaaaaaaaaaaaaaaagatatcctaagattatacagtgaattattttctagtgatgattcactggaaagcagatatgttattttcaagatttccagagaaagcaatgcatattaatgtttctcaaagtatagtttgtggaacagtcgtttctttccaggttagttagtaggtgagatacgtttagttagatttagaaaaagaaagggggttaaaggtccgtgaccaaatttatttgagagaagctgggttagatagtttttttgattttttctttttttaactgtagggcattctagagcttttcaagtgctcatgtgcattgtgaatctccaaaaagggtagggtagcattgctcaggagcatctcacagaactaatatgtcaccgaatacattttgagaaattttagtacacgtgctaaaattatctgaaaataaaaaaagcaatcatatgtattaattgtgtctaaatttaatgctatagtttgaatttttaaaattgtatttaaaaataaaaagaacaacaaaatatcatctaagaaattgctagtactctctcacaga

SEQ ID NO: 9960 - DNA, 584 bp, artificial
  synthetic oligonucleotide
taatagaatattctctattatattctaacttcaatttcagtttttctcattctctttttattctccaatgtctgaactatttctaatgttctttgttggaaatcatttatcagtttaatgaacacattcaaggaaggctaagcatagaggaggagtatggaagatttgattcttttattgcacacacagtataactacccatctctcatatagctgacacacacacttcaaacattaaattaactagaatgaaaacctcattctgaactctgattttccatacatagcaagcagcctgtgaaataccttaaattttatgtccaaatccattacacactgtggagaggaggatagcaaatgcatggttgaacatatgctcgtagacagcttccatattttgttaaattcatagctgaattgatccacaggattcaaggccagacactgagtatattaaaaagtgtggcatagttgggaatggaattgtattctggattaaattgcaacattggaaaaaagctcagaaacagaagcattttctattttgtaatctttctactatttatgtgaatttaagtatgtgg

SEQ ID NO: 9961 - DNA, 2211 bp, artificial
  synthetic oligonucleotide
cccaaacctgccgatgcaaccttagcctttctgctttctttccaaggtaccaaaccacttgtgtgacagttgaaaacccagatgctctgtttatatattttttcagattattagttactaaaacgaaagaaaactgtctccttctcctcaagaggaaataatacacattgaaatggactatgattggactgtgttcacaaatgaggaaagtcgttatatttaaaccaatccaggaaggagcttctgtcaagaggacctgtactcaatgaatcaatcaatgtattttttttctacccatcccagcctaagtgtgctaattattgttttgtgtccctgcaaaatatggttatccagaaaatagcaggagttcaagctttagatttaggcttacaaggaagtagaatagaatgcctattgaattttaagcctaagctgcattggagtgtgtgataggtggtatttaggagtgccctagataagaatgaaaatgaatctgtaatccaaaaataaaatcttagtctccctaactgactaagcagacccctctgggccaagggaacctcagagaaacctgaaaatttgaattgtaagacataatcggaggaggttgggcacaacttattatacctcctcccttttggactttaggttcaactgactagcattatcattaaaacagagatcataggattaacaaaacagactttttgcagcaataagatactaatttctgacctgactctggtccagcatcatttggcagatgacatatcctgaaaaaaatgaaaataatgtaccccaaaatacatttctttgacgtattttgaaatggccttataaagccatttttgttagtgaaatttgcatacgtagagaatctccattaatgcaggaagactttcctttctacgcctttcccaggtctaggagagagtaaatgagagtctgacacccttaaattctgaaaagagacatttaccaactattccctatgaaggctgctacctatgagacttcatctacataacaaaaccttaacctccacaatctcccttatcttaagtatttctttctaattacttcaagtacttagacaaaacttaactttctcaaccaattgacaattagagaatctttgaattcacctgtaacccataaacaacccccttcagcttcaaaatatgctctttaggtagtaccaatgtacacttcccatgtattaattttctaattttacctacaattcccattttcctaaattgtataaaaccaaattctaagccaacttatttaggcacactttctcagggcctcttgagactgttccctgagccatggtcagtcatattagctaggaataaacctctttaaatgtattacagagtttggtttttctattaacaggccttgtttcttattggctttatgctccatttatgtatacatgttaaaaaatttcccagaaaagcaggatgatttaagcacaccttattttgttatgactgtaattacatcttaatactctcacaaatttatcccagattttcacagctaacaagatgaatacataacatatagatcactgatttttatttcacctactatccaaatagtgtaatatcatgtgactggagactaaaatttgtaagagaaaaccttcagtttaaaaaaaatatatgttttataatacaaattcaacagaatgattggtggtgtgtaaaataaaacttatctcattataaagtagtgtttgatgatatatgatttcatgaatatctttacattgagctgttaataataaatatgttcattctgggtgaaatgagtcaacaatgaggtatgtctatttttaaagtaggtttagaaatagaaggcaaacagaagagcatttaaactgaaaaattattagcatataaagtttaatatccattggaatcaggtgactttaccattacatatttgtatatatataaaggtgtaggttgctaaagaaatatgagaaacatagaaatagcaggatggttacctaaagcttgttaatttttatttatttatttatttattttagtgaaaatgctgaggcttctttgaataagaaattttctctatgtcaaattcaaatgcttctggttttggccttaactgtgaagatcacagaaacagtttgtttggttctaattctattcaattgtgttagaaacctataataaa

SEQ ID NO: 9962 - DNA, 1121 bp, artificial
  synthetic oligonucleotide
tgtgtatatgtccataccatccatatgcacgtacatagcctgcatttcatggatcataataaaagttaaaagtgaatacatgttaaataatcagaggtgtcataaatattcactgtgcaggatttcctcaataggctgtcagcctgctgtagattactctgcagacacagcgtaaccttacttaaacatgggtctcttgagagcaatagagacacactgaaaagtaggaggagatgacattaatacaaaatgcaaagacatttctgcattttgcatcagtgaatttcgtgatcatctttttttcatcttgtaaacatttgggatgagccatttttttcatatttccctcactaaaacttacctagattttaaaagtcaataagaagaataccaaaattctaatgcctacttttaatgaagtctcattccaataaaatttaaagtagttccatagcatttcaaattctagtcaccaatatatgtggtggatttaaaactgtaaaactagatgcaaatcgaaagagagaccataaaggatttaaacaagatcctaatgggctctgcatttgcaccttataaatggccagccttatggctgtaaagaaatgatcagcacagtgcttcacaggacagtgaaataccacatttcttgaatctatatattttttgtacctatgtttaaaattgaactcaaatatttgattttttgtttgactttagggtatttcagtgacaaagagttgtttttcctctctctgactctaaatttgattaactctaaaatataaacagcagtctccatgcaatctcttccattccattttcaatgctgtttttatttttcctttatcacagcatgaatttagagccagatgaaaaagtcatttcaagaatctgaatggcagcattacatgagaattcctttcgttggccttgtgcatcagagtgtgctttgtttcctgggtattttggttaaaagcagtccggggattaaaacttctcatttatgaatctctggtggacttaaaatacctagtgtaagaatatgttgccagaaatacccccaccaaagtcttttttgcaaaggttcccttacaaagaagtggagaaaaatcaccacc

SEQ ID NO: 9963 - DNA, 263 bp, artificial
  synthetic oligonucleotide
tacatagagattactacagttaaacaaatgaacatacacaacatctcatgtagtggcctttctttttacagatattcttttctgttgatattaaggttggctaagggagaggatatgctagaaaggaaaaaagaggacttgataaggataatgagtgacacatgatagtgtttatcatgtgctgttctaaattctttgcatgtgattatccttatttaatcttctcagcatccctgtgaggtatatattattattatctttat

SEQ ID NO: 9964 - DNA, 507 bp, artificial
  synthetic oligonucleotide
atattatagtctctttttttctggcgaatagcacataactccagaaaaacaaaatagagaagctttgagcagaagtcttcatccaggtggaagcatttagtaccacaaattgctttaaattaatagttgttacaaagagactaagatgaaaatgtatatttagcaaatgatttgaggcaaccaaatgagaaaaaaggaaaaatgggcaagtaacattactgtttggttttactcatttaaaataaaatgattatactacagatgttaaatccgcaaaggtatataacctgtttcaagaagaaattacatcatctgttgagaaattttaaaatacatttttattgccattaaatcagtttttagcataaatgcatccttttttgtctttacttttttgattaaaaataaaaccactgctgtgttcccttagagcctaaaattatgctgacacatagtaggaacctattaaatatttgtttaattttgctatatcaggctcttttctcc

SEQ ID NO: 9965 - DNA, 876 bp, artificial
  synthetic oligonucleotide
tggtagattatttactcctctccaaacctaaaagtgactcaccaaaatttatgtcaggacaagatattctgatttcaactctagcttggcaaccaagagtcaccattataagacatgacagagttgctctgcaggacaagttgggaaacaactacaaaatcatgttgtaaacttcacagggagtcaagatttcacagggtgccagcctttcataacatagtttccacattcagtgagcattttatggtaagcttccaaagattgtgtttcacaacaaataactaaactctctgccaaagacttgagcttgtataaactcaagataaacatgagtctgaattgcatctctacttaaaaaaaaaaaaaaaaagacatgacgatggcttgtattaactggcatatattatcaaggaagtattaggttactctccaaccataggtcacaatcttacaagagccagactgaatatttaagaaagagacataaaaaatctgatattgattaaaagaccaacgtataagactggaatggattaaaggaatacggaaagctttccaactaattcagtaagtactacccgctctgagacaaggaaaaataagtgatttcttgcccataagagctcatggtctagtcggaaaaacaaagtgcacatacagaaaattgaacgctgtcaactcttaaacaatatgaacataaagtctaggtttgagcaattgggattttagctagatttttaacaaggattatacatcttttgtgaaaaacttataatgacctttcaacacctataggagaaatctggttttctcactttattccacactgtatcccaataatcccctggtcaagctagaaaggcttaacagtaggcc

SEQ ID NO: 9966 - DNA, 3879 bp, artificial
  synthetic oligonucleotide
aacatatttataataaaaactatatttcatgcttatcatacattattgtaaggtcttgaactatcccgtgaatcatggaacataactacattattaggtattgctttagtattgctgtacttaaattcttcaaataatgttgctcatatatgttcaattttatgttcaaataagttcaattttatttagaatattttaaaaatatttctaatttatttataaggatagtttttaaaaataagttcaattttatttagcatatttataaaagtgtcctttaaatatccatcaggaataacacagttcttaggccaagctgtttcattatatttcattcttgttaaatgtgacatttttcctattgtacgtggtgttgttttttaaatttaggtatcttagcttgaggattcatttccaaacttatatatagcatgccagggcttatgattttgttgtatcttttctcacatttcagcactgtggtagtgacgtctgatttagatctgatttgggacattgggagccgtatttaaaaacaaatatatacacctttgccaaaccttcatttttaatcattaaaaagatttttttctttaaagaatgtattgtttatatgtttgaactttctgattctttttgactgtttacagttaataaaaatgaaaattattaaattattttattgtttgatctatgagtttctcttatctgatgggttttttttgtttgtttctttttggttttaatagaacattcaaataaaaactttggcagatgatgtggtaaggtggtcttagcatgttattacattacttatgcatgttgccttttaattaaaatgggtggacataaaagcattgatatatgtaagatacaaaatgtctggatatttacaaagtatagtagaatggaataattgtcaattcagtgacttccttttcgaatattaacacaaacaattatatgagatcccaacagaattttcatatcatcctaatatttaccttaaccaaatgttttttaaaatcttgtgaatctagactctggaaaacacagatgcttccttttttgatggccaaataaattgtgaatgtattaaacattaatattggaggaaattaatttccattagaaaggaaattaagttcactgttagtcagatgtgtgctactaaatttaaaaaccagtattttaaagctgaatttgtcatagtatatctttttaaaagttatgggctcaaaatgtaaatatacccttttatagctaaactataaaaaatggtattttaagccttgtcagttttttttttcctatgtgaaattacctatttacaaataatttaaagtagtgatagtgctcaaaggagatgaaggtatgtggcttaactacattttctttttgagacagagtctcgccctgtcacccaggctggagtgcagtggcgcgatctcggctcactgcaacctcgcctcactgcaacctccacttccctggttcaagcaattcccctgcctcaccctcccaagtagctgggattacaggtgcccaccaccacgcctggccaaattttgtatttttagtagagatggggtttcaccgtcttagccagactggtctcaaacttttcctggtgatccacccacctcagtttcccaaagtgctgggattacaggcgtgagccaccgcacccagccaactacattttcttaccaaggtatagctgaaatcaaaagctaattttctagataaactgaaagacacagtggaatatcaaatatatatgttattaatgctactcagtaaaaaggctagtactggaaaagtaaatattaagtgatatgaagggaaaggagaagagatatgttgatttaatggtcagttgcatatttaaatgctttcatgtccaccatatttttagtgaaatttgactattggatatatcctcagcttattttggattacttaacttttttcttgagttgtttgaagatatactatataactaaaccaacttaatttccctcaaaaagttaaaagaaaatgtgaaaatatagttcaagatgattagaagaaatgaatcttaagttaatgtgaagactgggataggaaccaggggctgttggatttaggaaaatcaccttctctgtgaaatgaggggattggtttagattatttttcaagtttcttctcagctctaaaatactatgatttatataatgtctttgtcagcaactgtgtactcaaattgcttttgtaatcctaaataagctgcttaaaactgctcatatttctttcaaagtatactttttggttttaaaaaagtgttctttgaatttaaaataaaagttatgctcattaatgaggagttcacataattttacataagctatggtaataacttctgtgatgctctttgtattgttgaagtaattatataaggattctggttacatggcggtgaagatatattctcctgatatttaacatatctgcttgtttaatgtgagcttgatggtatgcatgtgcttcctaacagaaaccataataaaactgagttgcattcagttttatgcacattactaacttttgatgtcccatgttttgtggtttaaaatagaatatcctatttacatgcaactgaagtcattaactcactttatgtgaaatagcaagctaattattagagattttacatggaatcagtggttcgaagtcaatatccgtaaaatagcaagtttttcttaatgatatttgtaggaataagaaatttctgtttgttacatttccagtaaatggaaaagccgatgtttttatctttgttttgcttcctcattggcccaacattttagggaagaaaatgctgggggaaaataataatagtaacaacaataataaatagcagctaagtgcaataaacatattaacttatttaaatttcacagtaaccctatggtgtaagtaatatcattatccctatttcagagatgaggaaacagagagagaccaagtaaactttcacaaggttactcagctagtaaatggcagagcttggactgaaacccaagtaatctgtcttgagtccacgctcttaaccattctactgctacactgacacattattcatttatacttgtcacaatttttgcaactttgaaggagaaaaacattaccataattttctcttagaattggaaatcagtagctctttttcagtttctttctcttttttcatagttctaaagttgccaccaaagacacactctcccagaaacaaccaacaggactttgatccgagactttttttttcacttatttactgtgcaaaacagaaatgacaagggactaagttttacttttgaagaatacttttcacccccagagttctgaggctgaagagtacttcaaggtttcaaaatagtacaatctctaactggagcttgctgcttaaaatagtattttgtcagaagacaataatgatatgtattatactaagtgccgttttgatgtttcaattcttcatgttagtagttcttgatctttttctcagggctttttatttatttatttttgtttgcagcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggtaagttatacccctaattttgatgtaattttaaaatgtgtgtgcccagaatagcactgagttttaaggaggtgtgtttgtatggacagtgtttatatcacataaagaagagaccagaaacttga

SEQ ID NO: 9967 - DNA, 2139 bp, artificial
  synthetic oligonucleotide
aatggatcttttgaattatagacatgtgaaacaataggcataaaatatgccttcagaatagaaaatatgcagtgatcttttcacttcatgttggaataaattgtccagatcaaggaattaagcttttatccaaaatgacttacacatcaaattttttggccccatggagtttagattacctacttcaaaaactcctttcttttatccaatacatgtaacaataggatcataaaaagcaacccattgtttcttaacttccagtactataatattgctctgatgtttggattaatgattttccagatatatttttcatgtcttcttttttatttttgatgtgtctctatatattaaaaactacttataaacattaagtaaaatttttaaaacctaatgatttcactctcagtctcaatgactcataaagctattaagtttggtaattgcgtggtcattgtctctcagttttgcaaatgtgtttttcactaatattcattacttttaatcatctactggccacctttatacatacttatctattttgtttttgttgcttctttcaagacttgtttcttgcattttctttttttttttggtcttatctccatatattttcctatttattatgacctgtgataaactcacatttaagagctttagctatgttccccatctgccactcggagttcttttagaaattaaattagggctgatggaactattcatatggttggtaattaactgaagtttagctgaaatggaaattttgctccgatgaaatatccaatttcaccattagactgtaaaatgaagcaaaaatattttataagaaatctgaaaaatactttgtgggacaaagataaaataatatattgctttcttaatgtaatgaaaactcaagttttagactttcattagaatttctttacttatttattaagtgcgtgcatgcacacgcatgcacacacatattcatgcttagaaaataaatgaaaatggtgttttctctccttagttgacttgtgacacttaataaaacccaggtgccatttctttaggttcacagcttttgtagtgcagcacagctgtctgaatcagggaggataagagagagaaggcatgggaatatccatactgaggcttatactggcatatagtattcaaaagagccttttaaaaaaaatttctctttttcttcaccttaatttttcatacaaacatattggacaatttaaccacgaattccagacatctccagggagacccagtgacataagtagaatcttactttagaaaatcatatcagtatgcgctttatatgttattctttgttgaagaaatactgattgttcccatatttctccaaatttatggaatttttagggcaggctaatggagatatatctgatcaaggagcaacaactccaagatgcagtgatttcatataaaaaacaaagacagataactgcatttgaagaatattcatataattaggtagaacctcattgtgggggtatgggtttttggaagatcattgtacgttgcttttttaaattaaagatatattccatagacattctgaatgaaggttttttttttttttttttagtttggattacaaaggattctaggagatgaaagaagtcttttactattggcaagagcaattgaccccaaacaacccaacatgatgactgaaatagtaaaaatactttctgctatttgcattgttggagaagagaacatgtaagtattgctatattattatatttgctgcatggaaaatgacacttaagaaattaataagtcctacttttgttctctttctttggataactttcatgaaaacagtattttagataatttttgattgaaatttttatcttgcctgtttatattttggcttctttgttgacattatagaaactcagtttaaacagataaaatcctagtgggaaattcttgaaagttggattcaaagtgattgagcagaattttgttttgctggaggtacagcaatcattagaaagtggacaaaaatcagagagttattttggcaaatacacacacatacatacacaaatactgtgctgcatatcacacaatttgaatagatgcctttattttacattatcttat

SEQ ID NO: 9968 - DNA, 2286 bp, artificial
  synthetic oligonucleotide
caacactcttatgtggggtctaagaagtaagccatcgtatgcttaattctactttggagaaaatgttgacatttcaggttattttaggatattgaattacatcttgtcttttatctttattttaccttggttttccaggtcctcacttttattacaaaaatggatccatttgtgaaatctgatttctagtttactaaaagcatctaaatttctgcaactctatatcttgtctctactttccattttttatcaaataatgaaatacaaatgaatgcaaacaataataatttcagatttagtatttcatctggataacataaaactgattttgtgacctcttagcagtttacagcatgctcatttgccttctatcttatgtggcagtgaaaatagagtagtagtgatttgcatgaataatataggtcctctatcacaactacagggagatcaaaaggaaaccattttcactgatggcattgctgttccaatggtaccagctataatctggactttaaaatatgtataacggatcatttaagattttgacagtcaaatggtcttggacatgctcttgaggtctgtctctctagttaaaagatcaaaatgattccatagaatcattactttatgcagatgtttaaatactggatcatagagttgaaggtttaaaaacagtaatggaagcaagattataagtcaatgttttaaaaagttaaactcctttgttatgaatgagacttccatcaaggatctttaatatttttcctttactttctactgatatgaatgaagtctaccatcttctatataatatgctgaaggacactgctgctgaaaattacttcttatctattctacaacattttttgcttatcagaaatgattattatatcaggtaagaggcagttctgagagtactatatttataatttgaatcggatattaaaggaaaatgaacaatgtagtggggcctaagcaatatatgcatatgtgtgtgtatgtatatatatatgtatatatatatgtatgtatatatatatatgtatatatatatgtatgtatatatgtatatatatatatgtgtgtgtgtgtgtatatgtgtgtgtgtgtatatacacacacacacacatatacacacacacacacacacagggtataagagtttgactctttaggtaacattttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcccaggtaacattttttaaaaggtgttcattttttaaatttggccagaagagacagatgcacttgtaaaaatggggtactccagcgacaggactttggtagcaatgaacccaacagattgcactggccctgcaatgaattttctttgctagatagtgatatcacagaaaaagcactgaagattctgggatagaactttaaaggttttatcttgtgcatattaagtaaggttttactgttatttctctttttacagtatttatctactaataaatgtgatcttaacatctaagaaaataaaagtgctaatatttcagttttatgtctagtagtgtcatccttcaaaataaatgagtatgaaaataaccattaaagttaaaagttttagaatctagttaactgggaatatatcggaaaaccacaaagttatgaaaaggcttctgagtgactgaaattatccacagactggtgaccatgatgttacatttaactgttcaagagactcttagttgttcttcatactctgatttgcgtgaaattctgacaacctaggttctttgatttctcaaaacctgcttgattaaatggaaaaggaaagctaccatgaggtcagcacagtctcaacaaaaattacaactgtaaagcagcatagagaactattatagttcagaccagtacagtaatttgttgggcatcgtgacattacagagagataaaaaatgtttaaaatattaaattgtgtgctgttttttaagcaacaaggctggttatacgttaaaaattattgttgtatttttaattaagttctaacaaa

SEQ ID NO: 9969 - DNA, 1314 bp, artificial
  synthetic oligonucleotide
acattaaggttcgctcttggtgttgtatattctatgggtttgaacaaatgtataataacatgcatcctccactacatacatacatacattacatacagagtagatctctatatctcctctgtgttccactttttcattcttcccctcctcctaactcctgacaaccactgatctttttactgtctatagttcttgccttttctagaatgtcacctaaattgaacttatacagtatgtagccttttcagattgactcatttcaatttaggaatatgtatttaagtttcctccatgtatttttatggcttgctagcttgcttcattttagcactgaataatattccattgtctgaatgtaccacagtttatccattcacctactgaagaacattgtggttgcttcccagttttggcaattatgaataaaaccactataaacatccttgtgcaggttttcgtgtggtcataagatttcaattcatttgggtaaataccaaggagtgtgattgctgaatcttatggtaagagcatgtttcgttttgtaacaaactgctaaattatgttacaaagtgactgtaccactttgcaatgaatgagagttcctgttgctctacaatctcactagcattggtgttgtcagtgtgctaataggtatgtagtggttgttttaattttcaattccctaatgacatatgttgttgaacgtctttttgtatgctaattgccagctttatatcttctttgatgagatgtctgttaaggacttttgcccattgttttcactgctttgttcattttcttattgagttttaaaggtcctttgtatgttttggataacagtcctttatcagatatatcttctgcaaatattttctcccagtttgtgtctggtcttcttattcttttgatatgtctgtcacagaggagaagttttttgtgtttgatttctggttaaaaaaaattaaaaagcacatccctcttaggactgcagtttagaattttaatttaccatcatgaacactatttttaaacttgtggagggtgtagaaaggtgataacatgaatgtatgaatttttcaacagtttatgtgctcatcctttatcacaatacacagactatccttttaaattgtattaaaaactccacggtttcctgctatgttatcttggtgtcttggcatataataacgtttcttacaaggggtaaggggtgccacagaagttatctttatggttgaacatgatctggcagttcaatatattagcaggctacattacctaggtctacagtgaattgcataaacattcagccta

SEQ ID NO: 9970 - DNA, 526 bp, artificial
  synthetic oligonucleotide
caggacacacaataaaatccatggctgaattaagaatcctttagtcatcatagatgcttcccagcttaccattttagatattattgatattttattttctattatgttttttgaatccatagttagagaaggatcaagaatgaagacaaattaaaattttgacaccccaacctgcaataagaaaatttgtcaatagaacaggaactaatattttatgctaattccccctctgtcttggtttgcattcagtatgttctcaaatggtcaattaaaaaatgtttggcaattactatgagcctaattcaatgccaggtaccacaaagtaaataaaaataggtaaggcacagtgtctgttctcaagcagtttgaagtccatctggtgaaaggaatttatatgcacaaaatgcacagagaaccattaaattctaagataagtggtgcagaatatcaaagcaagagcagttctgaaaagcatatagtcatttttcatatagaatagttgccaaaatgactaaaaataaagatg

SEQ ID NO: 9971 - DNA, 1354 bp, artificial
  synthetic oligonucleotide
gactagcttacattctattagttcattaacaaatacttactagatgcctactgagtaaggcatgaaggaaatagagtagaatgtgcttgggtggatatgggagggaagtggaaataggttagggatcacagatgttacatgtcatatttggtcattaaaaaaaaagctgacagataatggtttgtgttttagaatctgtcaaatgagatattaagtgtgttaaaatgatcttgcccaagcaacatcatcaaaagatcttaacatcaaaatgactgtgttaaaatgattacctcaaactggccgcatcaaattgtttcatgttatgtaccttaatgggagataaattcaactaagtaaatgtcacttgattaaggagaatattaaatgtcaggtagaagagtttggacttactaacttaggcaagaagaaactattgcagattctgagtacagaaatggcatgatatacattgtacttaaggaataatcattcaggtaaactcagatggatgcatcaggctgtgatgtctggatgacactagctattaggaatatcctctaattcctcttgcttagattccaggctctccaaagtgatcctgtatttctaatttggcttcccttacaaatttgcctatagagagagagagagtactgctcagtggacacaagcacctggacagttgacagcaatgtgtcttattataaattaataaattgaatctctggtttatatatgtaaaaagaaatattaacctggcagcaatagttggattgcaaacttatctttaaataatctttaaatcacaaggaaaggaacaaagatattttcatcatgaatattaaaataacctgaactgaaaaatcttataaaagaattttaaaagttagactttgaaatgtgagctctgtaagcacatgccagcaacaaatacaaatacacattatgctaagtgaaataagccagacacagaaagaaaaatactgcatgatctcacttatatgtggaatctaaaaaagtcaaatacacagaaacagagtagaatggtggttttcagagcagggaggggaaagaaacaggaagacataggccaaaggatacaaagttgcacttaaagaaacagggagacataggccaaaggatacaaagttgcatttatataggatgaattagagatctaatatacagcagaaggactatggctaataatattgtattatagactgaaaatttcccaagaacactgtaggttttaggtcctcttaccacatacacaaaaaagatgggtatgttaattgactgtagtaatcatttcactatggagatgtatttcaaatcgtgatgttgtacacct

SEQ ID NO: 9972 - DNA, 4739 bp, artificial
  synthetic oligonucleotide
ataaaaataattatttttgtttgtgttctgagtttttagtgcttaagtaataaactagaagtaatgatgcatacagatattagcagagtactacaacatctaacaccacagacaaagagaataacaaacgaaggcaaattctactactaatagatatctctggatttgcagcacctagaataatgcttggtatgtagtaaaccctccccaaatatatctggaatgaacgaatgtttagcagctatgacatcaaaacacacgaattaaatctatcagcaaatgtttactgaattcctgctaagcacaaagcacaaatctgaaagttcatttgttttgcttatccatttctctctattattgtttgagtattttgtttatccatgtcaaagttctgacctattaagaagtgcagggatggggtgtggagccaagagggccgaataggaacagctccagtctacagctcccagcatgagcggcacagaagacaggtgatttctgcatttccaactgaggtaccaggttcatctcactggggagtgccggacagtggatgcaggacagtgggtgcagcgcaccgtgtgtgagccaaaccagggcgaggcatcacctcacccgggaagcagaaggggtcagggaattccctttcctagtcaaagaaaggggtgacagagggcacctggaaaatcgggtcacttccaccctaatactgcacttttccaacaggcttaacaaacggcacaccaggagattatatcccacacgtggctcggagggtcctacgcccatgcagcctcgctcattgctagcacagcagtctgagatcaagctgcaaggcagcagcaaggctgggggaggggcacctgccattgcccaggcttgcttaggtaaacaaagcagccaggaagctcgaactgggtggagcccaccacagatcaaggaggcctgcctgcctctgtaggctccacctccgggggcagggcacagacaaacaaaagacagcaataacctctgcagacttaaatgaccctgtctgacagcttcgaagagagcagtggttctcccagcatgcagtttgagatctgagaatgggcagactgcctcctcaagtgggtccctgacccccgagtagcctaactgggaggcaccccccagtaggggcggactgacacctcacatggccgggtactcctctgagacaaaacttccagaggaacgatcaggcagcagcatttgcggttcaccaatatccactcttctgcagccaccgctgctgatacccaggcaaacagggtctggaatggacctccagcaaactccaacagacctgcagctgagggtcctgactgttagaaggaaaactaacaaacagaaaggacatccacaccaaaaacccatctgtacgtcaccatcatcaaagaccaaaggtagataaaaccaaaaagatggggaaaaatcagagcagaaaaactggaaactctaaaaatcagagcacctctcctcctccaaaggaacacagctcctcaccagcaatggaacaaagctggatggagaatgactttgacgagttgagagaagaaggcttcagaagatcaaactactccgagctaaaggaggaagttcgaaccaatgccaaagaagttaaaaactttgaaaaaaaattagacgaatggataactagaataaccaatgcagagaagtccttgaaggacctgatggagctgaaaaccatggcatgagaaccagatgatgaatgcagaagcctcagtagccgatgcgatcaactggaagaaaaggtatcagcaatggaagatgaaatgaacgaaataaagcatgaagaaaagttcagagaaaaaagaataaaaagaaacgaacaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaaattcagattcaggaaatacagagaatgccacaaagatactcctcgagaagagcaactccaagacacataattgtcagattcaccgaagttgaaatgaagggaaaaatgttaagggcagccagagagaaaggtcgggttacccacaaagggaagctgatctcttggcagaaactctacaagccagaagagagtgggggccaatattcaacattcttaattaaagacttaaatgttagacctaaaaccataaaaaccctagaagaaaacctaggcaataccattgaggacataggcatgggcaaggacttcatgtctaaaacaccaaaagcaatggcaacaaaagccaaaattgacaaatggaatctaattaaactaaagagcttctgcacagcaaaagaaactaccatcacagtgaacaggcaacctacagaatgagagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaaaagacacatgaaaaaatgctcatcatcactggccatcagagaaatgaaatgcaaatcaaaaccacaatgagatacataccagttagaatggcgatcattaaaaagtcaggaaacaacaggtgctggacaggatgtggagaaataggaacacttttacactgttggtgggactgtaaactagttcaaccattgtggaagtcggtgtggtgattcctcagggatctagaactagaaataccatttgacccagccatcccattactgggtatatacccaaaggattataaatcatgctgctataaagacacatgcacacgtatgtttattgtggcactattcacaatagcaaagacttggaaccaacccaaatgtcaatcaataatagactggattaagaaaatgtggcacatatacaccatggaatactatacagccataaaaattgatgagttcatgtcctttgtagggacatggatgaagctggaaaccatcattctcagcaaactattgcaaggacgaaaaaccaaacactgcatgttctcactcataggtgggaattgaacaatgagaacacatggacacaagaaggggaacatcacacaccggggactgttgtggggtggggggaggggggagggatagcattgggagatatacctaatgctaaatgacaagttaatgggtgcagcacaccagcatggcacatgtctacatatgtaacaaacctgcacattgtgcacatgtaccctaaaacttaaagtataataataataaaataaaattaaaaaaaaaaaagaagagtgaaaggcagttcttccccaaccccagccccattccactcttcagagttaataactgcgggcagtctgctggatatctttctggtcttttgaatgcaaatattaatatgtagctgtatattttgcataaatgggattgtatcatatatacggccttgcacacaacttttttgcatagaatatttgcagccttttttccttgttgaaacacgtgtatcttatcccttttactcgctaaacaatatataccattgtataatatacataattcatttaaaaaaaaaagaagtgcagggataataatagtttaatttttagctcaactgatagaaatgttgttaaaaatctcagaagtcttgttttctaaaattctgggaatgggccctttggatccctaattattgtattacctagattgataccactttttttctccttcgttccttccttcctttcttttttttttttttttttgtctttaaggtagtgtcttgctcttttgcccaggctggaatgcagtggtgtgatcatagctcactgcagtcttgacttcctgggatcaagcgatcctaccacctcagtctcccaaatagctgggaccacaggcgtgtgccaccaagcccggctaattttttttttttttttttggaggcagaaattccctgtgttacccaggttggtctctaactcctgggctcaagcaatccccctgcctcagcctcccaaagttctggaattacaggcatgagccaccatgcctgccaagatgccactttctaaatataatgttccagctaactgtggtcaggtttaatagctatgtggttcatatcacacttttctatttcattgatggttgtgtcagcaggatagagttgacagcctcaaaaaagttccttcttcagtctatctggtctactgcagaaagagataaatttattctgataggatttggttttcacaagcctattacttaatttctttttccattcaaatggcctgcatatagatttggggcaatttttccaaacttgttttatataagaaaagaaggtaagcttagatgtctattatttctagaatcattttcctcttggggaaaatagataaatataaatgtataaatataccctcactgtagccctacaaaaactttgaccttatttttatagaattttggaataaaaatcatcaggatcttcagattttaatactatttttataactgaaaattatcacacagtcagcacagtcttttgtttcctctgacaattaatagaattctacaacatgatttttttgtagaaaatgaatacaata

SEQ ID NO: 9973 - DNA, 397 bp, artificial
  synthetic oligonucleotide
ttcatttatgataactgtttcaatattcttgtcttctaattgtagtatctgtgtcagttttcagacaattttgattggttgcatgttctcattatgggttatattttgctgcttctttccatgtctgataatttttgatttggtgtcagacttggtgaattttaacttgttggtgcaggatagtttcgtattcccatcaacattttaaactatattctatgatacagttaactggaaatagtttaatccttcttggtcttacttccaaaatttgttggggaggaccaaagccatgattaatctaaggctaattattccccactactggggcaatgcccttctgagtagtctacctatgaaatatgaggaatgtcagtctagctggtgcaatcagtta

SEQ ID NO: 9974 - DNA, 959 bp, artificial
  synthetic oligonucleotide
aagaaatactgagagaatttataatataatgttggggggtgccttgcttctctgatgttcattgtctgcacacatagtagattaatgaaaagtgaaagggagtggattttttttcactttttacactttaagaaacaaagaacaatattagatggtatttatcaaaaagtaaatacataattctagtgataatcatcaatatttttttcctttcctcagtacaaagatagataaaatgagtgccttcacttctgaatcctcaaggtttcctctagtgcaaggaccctgctttattcatctttgagtcctctgcactcaataatgtgactagcacttaatatgtagtcaataattttctgctgaatcaaactgtaagggtgaaaaaccaatcctcatagaacttgcaaagagacacatatgaaggcatacaagcaatagacactatggattttaaatcccaaagcatagttctttgccaatgatatttgtcaggtaattgaaattgcttattgtttaatccagtctatagttattattctaatagtaacatttatcacttacctactaggtgccaaacccttcagtggaaagtgagtatatttgtgttttaagattctcataagtcctgtgaagtagaaattgttatcacccaaagtgagattctgagagattaaataacttgctgaaggtcagacagttaatatatgacggaataagaataagaaacttaaatgtgtgtctccagagcctatactcttgctgtcacttatgatattgtctgaaactttgagctgagccatgtgtatatactttatgaacagcaagcatactgtttaaacaatgtcaatgaggattacattggacatatcaaaaaataatatcaaagagaaaatgttgagcattatgaaaaggagtttcctgtgtctagggatgattggtttgattatctatgtgtgcaa

SEQ ID NO: 9975 - DNA, 1021 bp, artificial
  synthetic oligonucleotide
attcagtccaggacaactactacatttgtactggaggtctcttccttaatcttgattgccctattcagttgtttgtgttcctcaaaggaactagttggcttttatctctgagatacaggcagaagctgaaagcagtgactttagaaacaatgattttgggaaaaaaaaaaaaaggaacttcctggggtaaagaaactcaggatatttcaacatacagagagttttttgacaatggctcaaattgtcatgacacaatgattaggaaacattgctaagatattaattagtctttcaatatattcatggtagaacttgcttgtctaactctgcttagtaaaaataggtaaattgcttcagggcttttcttttgatgggatgaatggtaatattcatgtgaatgtctgttccttagattttacagttttatagccaaggataataaacagcaagagttaggacctcaatggcattcacatgtccaaaacatttagcagacactcgctagaacctggggattcaggatgagcagcgccactgggattactaccactagactatacactacaaggatttgtttattgtaatctatccaacagctttccttgaatatttagcagcacgatcacttcccaggacaggttgccattcacaacattgattagtggtgcaactggttttccaccgacctatttctctgccatgcttttttgatagaacagccaccattctgacaataatgatgagacccaaaatagaaagaggaaaaagaatttcaaaattgaagtttgttaaaggttctctcttattttcacaactgcattatttgaaattctcaccttcaaccatcttaatgttgttctttgtggcaaataagctgctttgtttttgagcctcttcacagtacccacgaaagaagacacatgtaaagatagaactgagtctgagaggcactttctattactgaagcaaacacaatttgaaattacttgcgattccatcaaagaaaatatttagttaatgc

SEQ ID NO: 9976 - DNA, 1436 bp, artificial
  synthetic oligonucleotide
cccctttccaactaaaatctgtgtgtgactaaattttcttagtaaacttcaacccaaaccacaaagcataacagattggagaagcagatatgagaattcagatcatttatttctttttaaatttattttttcagagacagggtcatgctttgttgcccatgatggacatgaattcctgggctcaagcaatcctcctgccccagcctccagagtagctgggactatgggcacacaccatggagcctggcttgagaatacagctattttctattaagccatatgttgaagagtttttcaaaaatgtaaaaacaatgttgctctcctcagtaaataggccttttgttttataaaatataattatttttcacaaaacatgctgtattaacatgtaattttattattattttaatagaataaatattctaaaattttcttttttattttttattatggtaactatcaatagatataacccacataaacaaaagctctttgcagtcttcactggtttttaagattgtagataattattgagactgaaatataagagaatcactgccatacaacaaaaccatttcaattgacttaatatataataatgaatgataaaaattaaattgggaggaaaatatagaacattttcatgacattagaagaagcaaatatttcttaacatacaaaaagttactagccttagaagaaaaatatggaacactggactatattagaattaggaaattctcgtcatcaaaagaaaccgttagaaatgtaaaaaggtaacccatttacagtataggaagtgatattcataacgtatacatccaacaaaggactcacccaaaacacatgaaaaaaatgttataactcaacgagaaaaaagacagacaatagaaaaatgggcaaaagccttgagcagatgtttcacaaaattacccatctgctggaggtaggtctttcacaggctcttaagacctttggttttatctcagtagccacaacttttcaaagcatagtccaaggcccacttgcgtcaacatcacctgatagacttgtgaaaaaggaagaattatttttaccattctgtggggatggtatccaaatcactgggcactccacagtttttgacatctttcatgtgattgttatacattctaattgcttttgttcatctggagccctggaacactgttgttatttttgtttttaacatcatcatcatttggcgctaaggttgtttgtttccaatcatatctaacaaagtgcagggtgaaaattcacaatatattttctctcggagaaaaattgaaaggagtgatgattaccacaaaataagtatccaaaaggcaacctggaagtcactgttgatcatacaaagaccatttgtaaaggtatgctgatatgaaatctgtggtaggtaagggtatgtgagtggtata

SEQ ID NO: 9977 - DNA, 429 bp, artificial
  synthetic oligonucleotide
ttatacatttgttctaaaaaacaaataatgagggaacactttccaatgcattttattgtcagtattatcccactatcaacactagaaaaagacagcacaaataaagaaaaccacagattaatatctctcaggaagtttgatataaaaatcctcaataaaatattaggcaatcaatttaagcacagtataaataaataatatgccatgttacttaaagtatgcaagattggttcatcatttgaaaatcaaacaatgaaatccaccgtatcaacaggttaaagatgaaaagtcatatgatcctatcaaaagatacagaaaaagcatttaacaaaattcaatatccattcattataaaaactctcagcaatctcggaatgtagaggaatattctcaacttgttaaagtgcacctaatgaaagtcacagctaa

SEQ ID NO: 9978 - DNA, 1187 bp, artificial
  synthetic oligonucleotide
cttctaaaagtgtacctgtgttatagactgaagagggaatcataaaatgggattttatgcaaatcatctttataacagactagataagtggttttcaagcagtgtttcataaaacttagggtcagtggaggtgccaatgggcatcctgagatgaatgggggaaagtgtatatggtttaatgttccctcatttcctgtttaactagagatggtcctctttttttctgtttctgatcaggagtctatgcgagattttatgaaattcacaaacccccggaccataacactcttaagtgtacagaattttgtttatattatgttctttccatgctatcacagtcccttgagcattgcaagtactcaaggaacatatatttaaagagtgattgaatgagtaaatgaataaagtaaatgtataagaatttcagtttccttcctgcttatttcaagcactggatttccactatagtttctatgaactttaggcaacatatttcttctttgatttcattttcttgactttttttctatcaacattttagcgactttaatttatttttctgtagcatttcagatcttaataaatttggagataatcaatttcattatcatacattttaatttatcattagtagtctttctactcatacattaataaaaatatattattgaatgcttattttacacactctacctcaaattattttcatcagaaatcaattgggtcatggatatgtccattttataaagaaaaaataaagatcaaataatacgccccaaggtacccatagctagtaagagaaggaactgggatacacacccagactgatgtaattccaagtggcatgctttaaactattgcagtaaactagcagtcttcctctaaactttttagatttcttttcctcatgtctctgcttaaataaactggcataatcaataacgatattcacaaagctctttgtgtgagaggaaatctacactccctgacctcgtggtctctgccttgctgaaccatgatgcctaatgttataggcaaaagaaaagcttcttcagttctaaatgactgcatttcttaaccccaaggttcatttcagcaagcttggctgagtaccactttaagtaagacaaaggtgggaatgatgaaagttcacagttaagtttatcaggcaatgccatatacagcca

SEQ ID NO: 9979 - DNA, 973 bp, artificial
  synthetic oligonucleotide
cccattttgggccatgttatctgtaaatctatcataggggttggctcccttaggtccttattacctagggaaagagaataccatatgactgtagttcacagactgtattttgaattaagatttcctggagctcattacaaaggcagattctgtaccacattctcagatcttctgctttagaaattcttgggttagaaccagggagttccattttaacaataaccttagagataattctgatgcaaagtatcagcagatctcactgtgagaaacacttcttaggacattatcctccagcaccataattaagaggattatttgatggctatgccctgaaataataggacacagaacacccctagagtatgagagtagtgaacactcacaacagatatggaaaggtgcaaacggtgtcatctacttggtaatgtagctcagggccttccctggttgcctgcccatccaaggttttaccattaccaagaactataggaatttgaagcatagtctttctgggaatttccatacactttgaaattaaagagcacaggcataaatagaatagtagcaccaaaaattaaagaccagaaatttctgtacttcacaataagcagtgctgtaagaaagagttggtgatgatagtgatttctaaaaaagtaccttttcccctttaccttctagaatgcaaatcagttcacttatcctttaatcagaggatagtcttatgttttcattttcttcagtgtagtaaaaatatttaatgacatatcctattagatgtttcttttggaattcacatgacagaaatcaatgcagctaaaatattgtcacagcaggtctatctacaatacgtattcactctttaatccttggactataatgtgagacataaatacacaataaaagagaggagtggcattatcatttgtcatagcaaaaacacatttagcgatcaagtagttggtgtaatata

SEQ ID NO: 9980 - DNA, 740 bp, artificial
  synthetic oligonucleotide
tcatttttattttcatgtttacttcacaattaaagtgggttttacattctctttattttgttctttattcagctgagtatctaaaatcaatcacagctatctgggtttttatgaaaatataaaattcttgtgattcagataggttatttgcccttataggaacttaataatatatggtctcatccttgcacaataatgtaacatttcagatgtaaataccaatactaaaagcaaaataaaaatatatgaaaaagtttctactaatttaaatagctttatttttgcaatgtttatattttattaaattttaaaacctccaaaaatattgtcaggttttgcttttgtttttatggtctgtgatatatggagcctctctggctcacatagtttcatgggcctcttcattggcccgttttcccatgtagactttaactgcttctcattggaacttcacagagcctaactgatatgtttgtcctgtccactttatcaattcaacatgtacagtcattgaagtaaaaaattaaagaaggataaagaaaagggagggaagtggtaatttattcaatacagctccaaatccctttaatttattttaaatcagcaatctggctaccaaataatagcatggcttaaaatgtttcttgtcaagtgcagagcatttaattgtacttaacaaaatatcttattgatcagaaatgtttttgtattcccagaaacttcactattaaatgccagtg

SEQ ID NO: 9981 - DNA, 323 bp, artificial
  synthetic oligonucleotide
aaaatgctgctttaaagggtttatgtgattatgtcaggatctcccagataatttccctatcttaaggttgactatgccatataacataatctaatcacagaagtaagattcacaatatttacatcccaggtacagtgcaggatgcgtatatggtgggggaggaggaggttagtggtaaattgtgggtgccattttagatttccatctaccacacttaggaaaattggacttagtattattaattcatttaataaatagtttgtaatcccctactatgtataaggtgctgttctatttgaggagttattactttcaaccagaaa

SEQ ID NO: 9982 - DNA, 772 bp, artificial
  synthetic oligonucleotide
tactatgcattttcttcatctggcctggtgacttgtagtatccaaccatttttgtattacatctatccttttccttttgccttcgttcagctgatagctatgagtatcctatactcaggttcatatatttcaatatgtattccaatccagcttttccttattcatattccttacattcctttgaattttctatcactctaccaaaaataagccccaatatacctttcacagattctgtagatgctcctcagagacaagattcaggaggcatagtctggaaagagaaaccggctcctaaataatgaattttttttttctcaaaatgtgaaaatttgtctttcctaacatttagtcattcctgtttctgcattgcaatgctattttggtctgggtcttgtgaatgggtgttcagactgtcattttaatttagcaccatcattgctatagagcagctgtccagaattcatatttctaaaggatttttttaaaaacaactatttctaaatagatagaagttctgcatgctacgatgacaacaaaaatctctgtgtgcttgtacaagttttctcctttggatttctgtattttcaaatgtttataatacttttcaggttcaaaatagttttatgcaatggtttgctttacatacacctacacacaaatacatatccatgcacataagattcttctcaccattatctaccttcagcatggaccagacataaaaacattgaaaacaacatcctgtagcatcacttaggctgtagggctg

SEQ ID NO: 9983 - DNA, 892 bp, artificial
  synthetic oligonucleotide
aggctagctgttagtgggtagaaaagatggtgcagatctcatcctgactcagcacatgctaagagctaaactgtctgtcaaaaggaattctttataaaataaaatttaaaagctgagacttaaagtgtacactaatgacctggtaattgtcttaatgacttttcaatgaagtgtgaaattctctgttaacatgtcaacagagtgtgaaatattttacaagcatggctttattataaaactgtgtacttgctgtgtagtctactagtaatccttgttgcttatccagtaaatatttctggttatattctgagcacttagccaattaacatttatattggctggtaatcttttttccattttttcatttgactgtttgtactgtttgtctatttgttaaatctggggaccagagaagactctcctagttttctttgatgacaaatatctcacttgggtgactccaagagaaaaaaacagtttcaggtacagaaaaattaaaatgcttaaccaagttatccagtaatgatattgagataataaatcagacttcctgacctccattcttgcacacatatcatgacttcattctagatatcataggataaggcaaaattaataaataaaacaaaaaatgcattttatttttatattatgcaattaaaacatgaagaaaattgaataaatgatataaatattatttgctgccccattgtcaggattttgcatgatacttctttagtaaatgggattttagcagaagtgacaacatgcaagttgacagcagatcttttacatgcaatcatattgtttgattttctctcccctgccctccactatgagactagcatgtccaagataggagctatttttcagctggtgttctagaaagaga

SEQ ID NO: 9984 - DNA, 1186 bp, artificial
  synthetic oligonucleotide
catgaaactgtgggaggctaacatgtttcctttgcaaataaggcaaaatctcagattcttcacccttattgctagttattactttgagaactttatcttgatatggtactagcacaataattcaaagataattgcaaaaatatgtttatggcactaatacttctattgcagaaaaactgaaaacaacctaaatgtccatgaaaattgctcattaaataagtcattacctgccaatgatagaatactgtgaagccataaaaaatgaatatatcgtcctatagttattgaacatgatagatatctgtgacaagatattaactataaaatcaagttattgaacagtgtagtatagttctatttttgttagtaaattaatttctttctggcttcctctctttcacacacacacaaacacacacacacacacacacacacacacgtcccacacgcatttcaagatagatatatatcaatatgttagtaatggttaactcagaatagtggattatagaatgattttaagtttttctgcttatctatattttctgattttcctaaaattatcatgtgttatttgtacatttaaaaaataaatgattcatgctaaaaaaattctgcagctgcctttggaattcatatctcaggaagtatctgaattatcacacatctgacccattagtgaagctcatttcaaagaggaactgattgagctgaaagcaaactacacccactacataggcataatatctgtcaaattttggagaggaaaatataattgcacaaataattctaaaacttctggctatgtgaccaaactctgggctatgtctgggtccatctggctctatgaaagcatattttcctttatgtaacttctgaaatcactattaaggccactagagatggaaagctggagttactgctttgagtaaatttacccttggttccagaataagtcctctgatcacagcaatattctcattgatttgtaactgtgcattttgtataaacacaatttttaaaaaataatttaactgatttttatcactgcttaaatgcatgttttaaaatatggaaggttatacttcaccatgatctttatatataaattacataaatatgtctttcttttttcctcactttaaatcctcaagctcacaaaagtaatagaatatataaatatact

SEQ ID NO: 9985 - DNA, 1376 bp, artificial
  synthetic oligonucleotide
ttgcagagacctgaccttggactttccctaggactggacactagcaactgcaggtactcctggccttggacttctttcttgcctctgctaatgctttagatgagggccagatgcaatcaaatacatgggctgtaactgatttctttggagtccttgaaacaagaagcctggcagtgagaagaagaaacagcagatctcccaggatagtgtgagaactaagagagtagaatggaaatgggtcttggggagaggggagggcaggcatcagggcacttctccgaagaaaaacaaaatgttgggccattgcccttttcagagaccaatcaaaataagaaagagggaagaagcagtctatcttactaagttgcttttaaactgcaaaattttatgcctggctgttctacttgctagtttcatctcctgtgatgtgaagaaagaatgagtttttgcttcactgaagattctacttctaagttgtgtccttaaggtattacatgttaacaaaatgttgacagatcagacagcatttttaaatgcttcttttttttgactatgcttttttttcttaagcagaagtactgctagcagcaccttcagtgttcatttcatcaaaggactctctaaacatatcgtgtatttattgcgtctttgggagtaataattttcttcccagctttcaaattactacatatttgttactgcaccactgaggaaggagatcatttgttattagttccttgtctgacgtgaaacatttaatttgaactgaaaccactgcacaagaaaataaacagtgcatttcatacgcaaaagtgtctgcttccctcactgggaggcagtgggaatcattttgaccatatggtgggtgtttatcatcagatggctcataagcatctctgctgtctgcctccattttcccttcagacctgggtactggctctttttcaaagaagctaggtcagcttgctttcagacagagcatctaaactctggaagctcaccagaattccaacagattttttaaaaataccgatgaccagaccacaccactctcaggtctgtcaacaaaactctctaagggtaagacagtttagtgaaatgtttactttcttgggctctgaagccagactgcttgggtatgacacccagttttgccacttaagaccatcagtttgtgtgcaagttatttaaactctctgggcctcagttatctcaaatgcaaaatgagggtaatattacctaagtcacagggttatggtgaggactaaataaaattaattatgtgaagtaattaaagcaaagcctggtcatagtaaacacctgatgatgttagctgttactttttctgatgagcacccttattcttaatatctgat

SEQ ID NO: 9986 - DNA, 827 bp, artificial
  synthetic oligonucleotide
gtgatggctaataaaaagaaacatctgaacacagtgcttgagaagcatttttgtactgttcaacagactgaaaataatacccttttttctggtctgcattaccattaataacagccttctcttctggtcatgtgtgtttacagagggaataaagattgataccaagagcttgcctttttttcttccccactcaactagacacagactgtccggatgatatttttagcacaaaccaactttgatttttagaagttaaacgattactagtctctaaatattttcagaaattacttggatctgtgaggaagctagaaatttttccaggtagctctcagaaaaagttgtttagaaagtaaaaggttatgctcacatcttgcctttgtttaaggaagctcttgaactctcctgagaggaaatattccatctgttctatccgctttctcttgaccacacctggaagaatgtccagggtagaatagaagagtgattgtacactagatagaataatccatgaactgcaggttgtcagctcccccagtgtatttaagatggaattgccgttacaaaatttcaacatattcacaagcatttcatataagaagggtcccctggagttcaatgaaccttttattccaacttataaataataagtgctttcatgaattgattcccactcctcttctcatcttgtctccattccatagtgttcaactcatctctgccatgaccaaaacagcctctcacttagttctataagacctcatctctcttccttcagttttgtggccttccctcatcacagcaaatctttctgcttagaaactcat

SEQ ID NO: 9987 - DNA, 1103 bp, artificial
  synthetic oligonucleotide
atgataacaagtaaggtttctgcacaggagctcaagctcccggagttggcagagttgctgtccccacagctgcaggaatgttcctcatcattcccctggggggcacagggaggtgctagcagcctgggtacacccactagaagctgagtgaccccactatgcagcccacacaaaaactactctaaatacacaacagccaaataggaaatgtaacttgaagagcatttccctctgcaaacaactgatcctctgggattttcacttcaagcctctcaattgttcgaagtaaatgaggctcacatcaaaggccagccagtcacgcatcaagaaatcaagcctcttctccgtgggggaaaatggctgctccagagccatcctcccacctctcacacacaggcctcttgtaaaaacggctttatttacccaaatctgagacactcgattcaaccaagcttggcctcccctaaatcctggaagctgaggtacacatgcagaggggccaacatctgaaactcgaggcagacgcctaagagccacagcactgccacaattgaaagactccagctttgccaggaggtgacttcatcctttttcagtcccctaattcctaacaagcaatcccctaagcccttagcttctgcgctgggcacaataagcccaagccacagcacaagctggggcaaggttagggagagagaggtctgcagctcatcctaccttgtaagtctgactgacaatcagagaaaaaaccaggtggagccacctggacccaaaacaagtggtcctctgataagaggaattccaaagccttagagccctctgtggaaaatgtcctgcctccagccccttggggagaaaaatctcaggatgattagcaagagctctggctgagctcaacttcagtgaaggtgtacggggagagaggtgatctctaaggtaaccagttaattgccgataaggaatgataataataaattagcagatactaatgtaaactaactcagttctgcagttctgtggcagttgcatggagacaacagaggaacagtttattctggaacacatcttgcaagcccatccccactgggaaaccggctgtctca

SEQ ID NO: 9988 - DNA, 1571 bp, artificial
  synthetic oligonucleotide
gcagggcccctggatcggttcgctcttgtctgttgcttgttaatcaaatgggatatgtggcacagagaatgagctacggagggggccggacacatttcattgcccctcaccccaccctgttggagaatttagctccctataaataaactgtacgtttgagaagagccggtggagcggacgccgccgcgccgcgccaagccagcagagctcaaagccgggcaggagctctggggcgggcacgccatacatgtccgcttaggtcgccgacagctgggagccggcgccgatgtgcagggcgccccagccttcccgcggggtctcggtcccagggggctgccagctccacttgggcggcggtggtggctgcggcatgtgccagtactgggaagcgggaggccggcgtggccagggctgacatcaagctcatcctgccttctgcactgaaggctccctgggggcagcggggcattcctccccacccgggctctgaggcttttaattaaggtcgccagcggcaaaaaaatcaaaaacgtgcccgttaaacaagtttttttttctcttagaatgtggggaagctgcttctgaattcacaattcttggaagagtaaaaatgtcttctgagtgagtcgtctcggatatttgggagtgggataagcagactcataattagcccagcgacattggctcgagcctgtgggcttcacatgagcgtcatttttgccctctaaaaagcgttaaacaagaaaaggaaaccggcatttggacacataatgggttttctcaaaactgccatcttcttgtggagagcaacccagctgctttttaaaatatttttccttccaagaagagctactttagcagcctttaccttggcggtgggagaggggaaaggcggcttcctcttacagaaagaaattatttcgcgagtgagattgcgatcccctgaatatgtagccgaggccaaagggagagcgtagggagcctgatccgctttccgcgtgggggtcgtttcactgtttcacgttaggatgtgattcggcccagaacaacagggagaaaaccgatgcttctgcaatgagtatcatttaattttggtcatttagagctgcgggtggacaccagagtggtggctcaagggagcccggtggcccgaccggttttctccagacaccgttggagaaatgggcaagtagtagagaatgacaacatggcaggcagcggtgggcgcacctcgcgggctccgcgaaaggaagggttccatttgatttatcacagttatttacctttgatgtcagagcatgggaatgaagtgcatcttggtctaattaaaaaggcctaaaaaggcatttgaaatgggtttgctatctgatcacgggatgtgaattcggcgtttggcagctttctaaaatattgcttggactatttaaacagaacaattagcagcatgctaaaatgtttgcatgctatgcttagaagcttttagctgtaaactttaaggcgatctgttccccctttaagttaaaaaaggatgatgctgcttccttgtggcgaaggctgtcaggaacccactg

SEQ ID NO: 9989 - DNA, 676 bp, artificial
  synthetic oligonucleotide
cacaacagaactgatccctgttctccaaacgtgccctgtgcttttctgccttcgtactcaatattctgtccacctgcaacttttcctgtccaccccatcttcaactacatacacctcaaaatccagctcctgcctaccctaaattactctgcctaccatccccccagagtgcatttctatatgcaccttcaccattatccggttaacacttggcttcaagctagctgaaaagattgacgttttttgaagctaaaaagaaacttcaggtggaatttcccattctcccagctaaacataataaccctcttaatgcttgtacttagggtgatcctagaactgtctcttcttccaaaatgtttcagttcattgccaaagcactgttgaggttaaagattgttaaaatgtctcacctagcttaaaatcaaattttaggacttcatcaaaatttgaaatgttttattcagggatcaaaatattggtccccaaacactgggcttctcccaaaatatttctcactcccctacatggcttacacaaagaaacaaacacacgaacacacacaaactcagaggcccaaagcaagtcacctgcattgtcaaacactgggtgtaattctcagtgaatactctagatggtagcattgtgcattttattctcctattcttttcattgattt

SEQ ID NO: 9990 - DNA, 1485 bp, artificial
  synthetic oligonucleotide
aggaggtccaggatgtacagaagactcatttttgccacaaatatacaaggtctagggtcaaccctgccaagcacagtactctggaattttacgtcctctaatcctgaagaagcagggtactgggggaagaaaagcttgattagaaagtcaccacttttcaagccaccagaattctaaccaaatgatttcaccaccccaaatcccacctcattcaatgttaagggttggaggaacacctttttctgccccattacaaaccaacacaggagacagaagcattctgtgccccttctgagatctcggggaccctcctccagtaccagatctctcacagcctgcttgaagagcggcaatataaagcagctccacagcacacagccaggtccccagccccaagcgcagagggagcccactgaggcaggactccagccaaccagcctccagcctttacctgtggctgactggccaacgccagagaagccgcgatgtcgtaggtccgaagagagtgcgggttagcgaccccgctcgacggccgagcgctgtgagaggaacccacgaaaaggtgactggacgccttggagggcgcagttcccgctaggagctcggccccgcccccgcccccagggccagctctcgggaggggcaccagctcgggctggcgggaaaagcccgggcactccccgcgaggggagccgaagaggagaggggaggcggctcccagaggggcacagaccgcattagtgctgggtgggtcagggaaggggccagaagaagccctggagaaagaaaagtggccgggagggaccgcccaagcagacgggagtccaagcctggggatgcggtcgggagaggcggacggggagaggggagacgcggtcagctagggagaaggaaaaattgggggaccagagagcgggtagggaagacgcacgaccccgagatgggggtgggggcgcttcagcagcgaaaaggagctgggggtccagaaggagcaccggaccgagggcgaggggccggccgctggctgttgacctacctgtcacttgcaacaggtgcctccagagatcgagaagtcccagtgccggtttcaagggagggtctccggctccgggaagatcgcaacccagctccggcagccggcccttctcaccctcccgggaggcggaaaaagctgcaactttccctggagcggggaggagctggactcttaaaggggccgcacagcgccccgggctccttagcagggggccactcagcccaaaagggagctctgggacccaaagccttgagacacaagaggaatgtccttccaggttaggaatgggagcctggggactgaggataggggtctaacactagacgtgcctcctcacccacttacttccatctgttggtcactctcttagacggtgaaatcacctgtctctttcgttcagctgagtcaaaagttgtcaaattgtctcacacttctaagaagataaaaga

SEQ ID NO: 9991 - DNA, 582 bp, artificial
  synthetic oligonucleotide
aaatccatcactacccagatatcaagatactcttttatattttcttctagaaattttatatttttgcattttacatttatgttttgaatccacctggagctgattttcatgtatggtatccaatttactacttttaaatatggaaaacgaattgccccagcatcatttttgaaaagtactttttatttttatttttatttttttgagacagggtctcactctgtcacccaggttggagtacagtggtgtgatctcccttcactgcaaccttcacctcctgggttcaagtgattctcatgccttagccacccgagtagctgggattacaggcaagcgccatcatgcctggctaatttttgtatttttagtagagacagggttttgctgtgctggccagtctggtcttgacctcctggcctcatgtgatccacccacgtgggcctctcaaagtgctgggattacaggcatgagccactgcgctcagccatttttgaaaagtactttcaaaaatatactttcttcgctgatctaaaatgtcagttctattatatatgaaatgtctatatacacgagtttcttccg

SEQ ID NO: 9992 - DNA, 844 bp, artificial
  synthetic oligonucleotide
tggttaaaattgttgctattataatcattggcatacagctatacctgcaggcggaggactcttgtaccgaggaaaactgcagtgagcaagctggccatgtaaactgagccattcgtggaaggtccaaaagatagacacaggcagagagaggcatgagtttccagagttcctcatgagagagagagaaatgggcagtaccattacccacagtcccacaggactgagaagcttgaccttctaggggaagagctttgagccctaaggggaaagtggagtctacttcatatccgcaagagtaatccagctgcctgcagctgatgggtagaaatggcagtctgctcagggagaagattgtcagggtggccaaggccaagtattcctgttcatgcccttgccacatctctggtatgttaggatatcggtgacaacctcttctccttgccttgccctaacatcagggagagaagcgtgttcattagaactctttgtcccaccctcagaggctgttaagagctggcaatgaaattcagacatccccttttgggcttgacaacctctttgggagaatagagcaagggagtagctgggggccttaagagcattagtggccagctttttttctctttctcttctcctttaccagcctctgtccaggttccctgggaaagagcaatttcacccaataaagttccctactacatcaagtgagtgaccatctgaatcagaagcgggtcagtcacctgcccaccccctccctctcctgcctttttgctacctgtccttgtcactctgtctgttgggattcctccatccagttcggtttttctcctactcatctcaagat

SEQ ID NO: 9993 - DNA, 1716 bp, artificial
  synthetic oligonucleotide
cccgcggctggccctctggctttgcctgggaggctggcttgccctcgccttgtggcttgccctcaccttcggacttgccctgcttttcctggcttcccttatcttccagttgtccctcatcacctggctctccctcagcctttcgctttccctcgcattctgtcttcccctccgcgtctggcttttcttcctcgtctgactttccttcatcatcaggctctacttcatcttctggctttccctcgttttccaggtttccttcatttttattgtagggtttttccatgtcgagatttctctttttcctgtcctgggggatgacagtggagggaagaggagacaaataagagacatgggagactgagggcatggggtggaatgcaggtctggatactacttgcatctcacccctggtgagggttcccctaagctggccgggcctccaagagggccttctgcccagcacgtagcccaccactcctcccacacacgtgagccagccataccctggcaggccctgccaccttctctgaactgattcagcctggtaaggtgtgtgttcacgtgggtggggttatgtgcaggggtcccaatttggccttggccgggccctccacactctcaacccttgtgggcccctgtccatgcagccccctgctttcacggacctgcggggagtctggacaggttgctcttcctttgcaggcctccaagagcgctgggaacaacagacgcgcagacctgcggacagacaggagacaggggtaggggctgcgcgctcagcgggctcacagggactccgttcccttttctgagtctaggccctgctcacccaatgttttcctcccctacctcccccgcaccccagccgccatttctttccaggcctcgggcaccaaaccaggatgcttccaaactgcgtttgcctctttgtgccccttcccccggaggcaacctgtctcagcgccaccccgtttttgcggaggtcagatgtttccatgggagcggattgtgagagggggttatttccagaataagtctgtgtttcactgtcgcactgcggggtcgctacccccagccccccatttccagcactaaaatggatggagggctcagtgcaaggggcgtcgagaaggcgagccaggttcgcttcggggtgctccctcccctgcccccgccccggcccgctcagcatccccctcctccccaatctaccggatcccttctccgccccctccccaatcctactgccagccccctccacccctgtcccagggtccgccggcagcgcacgccttcacactgacctgcggggacccaggacaggcctgtgcctcctgcggctcgctgaagcccgctcgctgctcccccgccgcctgggcagctcagacagctgattctgcgcgggcgcctggaccggaccgctgggcgggcgggcgggcgcgggggctggtgcccacgtaggcgcctggtcactcacgtgagcaccgcgtcacgggagctaggccaccaccacccccttcccgcccacctcaccatccatccccgagggaccaggaggttgcggaaggtgggagagggtgtgtgtaacaaaggagtgggggtcatcaagaagaagaggaggagggggtggctttctgatctcaggtgctttacctgacgcagctcacagcatcctcgcaaggcatctctctctgatgcccattatcgccaggt

SEQ ID NO: 9994 - DNA, 1408 bp, artificial
  synthetic oligonucleotide
ctgtatctgttaaggttggtgtaaaggtacagggacaggggggcaacttcgactagagaattccatctcttctgttttgtcattttaccaattattcccatctgccccaccccctgctgctgctgatttagttgggagtcttggtaagttgtgggggtacagaatgctaagctgcctttcccactctccactgcttgtcctgctctcacgcttgaacctagtctaatctgaacgagggacattctagggcaatcactgaagaggaagatggtgggcaataggaaggaggaggaggagtagccctgaaacaaagcagtgggggagaggggataggaggagggaaacactagacaaaatctggaaaggcaagaataagggcaagggaccaaggtctgtcaccaggagatcagtttccacattctcctgtttgtttatttgtccataggtctgcctgtagatctgctgtagggcttgtcaccattggaagcaaggtaaggaggagaaagttactccagatcagtgcaggttggtatgagtgtggggattgcctgggtagacctgtaggatggagtagtggagagctgcttggctccagcaggggtcaagaaccactaaagggattcctcagcttctcatccagttttcctactccttatgctcctgtttggtgactggaaagaaggctgatggcacttggaagtgtagggagtgggtgaaatgaagggagagagagtttgctaattatctacctctctcacctagcactgaatcaccatattctcctgtctccctgtgctgatcagcatgaggagaaaaaagttggaagagactcaaagccccatttccttcctccacccctaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaa

SEQ ID NO: 9995 - DNA, 943 bp, artificial
  synthetic oligonucleotide
agattcagagcaattcaaatggaaatcctattaaaaaatttttaaagaaaccgacaggctgattctaacattcatatggacatgtaaaagacctagactctattagtctgttcccatattgctaaaaacaaacacatgaaactgggtgatttattttaaaaaaggggttttcatggcttacggttctgcaggctatataggaaccatagaggcatctgcttctggagaggcctcagggagctttaactcatggcgaaaggtaaagcggaagcaggcgttttacatggcagggaaggtgctacacacttgtaaacaaccagatcttatgagaattctattatgagaacagaaccaaagggagaaatccactctcacgatccaatcacctcccaccagtcctcatatccaacattggggattacaatttgacatgagatttgggtagggacacagttccaaaccatatcaactatgaagtacaactttgataaagaacaaaattagaagacaaacactacctgatttcaagactccttacaaacatacagtaatccagacagtgtgctattggcatcaagatggattagtagatcaaaggaacagaataaagagtccagctatagacccacaagtatatggacaactgagtttgacaaagatgcaatggtgattcagtggagaaaggattattgtttcaacaaatggtgctgggacaagtgaatattgacatgcacaaatataaactgtgactcagatatcacactatatacaaaagtctattcaaaatggacctgagatctaaatataaaatttgatgctataaaacttctagcagaaaaaaaaaaaacaggagaaaatctttttgacaatgggtcaggtgaagatttcatagatgagacaacaaaaccacaatctataagcaaagaaattgaaaaattggact

SEQ ID NO: 9996 - DNA, 571 bp, artificial
  synthetic oligonucleotide
aataatatatttaacacagtatatccaaaatgctatcacttcaacacataatcaatataaaattactgatatttcactttattgtactatgtctttaaaatcctgtgtgtactttatacttttagcacatctccaattgcattagtcactttttaagttctcaatagccaaatatggctcatggttaccttattgtaaattgcagatttggagcataaaaagtattgaattccgcattggtctgaatctcaatcatttgctgaacgattgcttcatatcacttttgaaatgtatttgatatgaattaaagaatacaaattgaagtgcctctaggggccaggaaggtaactaggtaatgtaaacaagctttactttctttaaagctgagtaaggaaagtaaaacggaaacacctgcctttctaaaggattgaaaccaccactaggctacctccagtcaactgatgcaatgtgggaatgcaaccccagggtttacaaaactcctggtttttcatgaaaatctaaaatctcgatttttcctgtggaatttatcaatttttaaatatcagcagtg

SEQ ID NO: 9997 - DNA, 1505 bp, artificial
  synthetic oligonucleotide
ttgattgtaaacgacctcttccgctctctctgcagtcagtctgttccccttacattgcttctctgaatttactcttaagatgatctaggatgttaactcctagtaataaaggacagattacatactttcctgcccttacaaaagtatctagtgtccacacaaatccaacacaattccccctgttctccttctgaacattagatccactttgccaggacactcactgtgatcttgaaccagctccctaaggtcccatccggcatgttcccctccattcttctctctggaggtttttgctctctctccatgttaacgtgggtttggtcttgtttacgaaaactgcctttccgattatagggtgaaatagtatagggagtgctgtgagcaagtggagaaaaggtagttcacatatgctccgaaagtattttatacacatttgatccactgataccagggctacaatgaagttaaatcaaccattaatcgagttctgtcattcctctctctgtcaagttggaaagaatgacatattcagctacagagttatgtatttcactggctggtacattccagccatgctgactactggtcacttactatcttactggagagtccatgtgggcaccatgcattgctgcatctccatcttgctgctgatgggatgaagaatgcatgccaggattgacaggttcagacctactgctaaatctcctttggtaaatatcccaacatcttgctcttctttgaacaacttgatcagtgtgaccttaaattaagaacagcacatcaacacttagaataccagaaaaaaatcttgggaaaatataatggataatgaaaaaattcactgatatttatttatttagagtcaggatctggctctactgcccagactgtagtgcagtggcatgatcaccactcactgtggccttgtcctctatggcttaagaaatcctcccacctcagcctcccaagtagctgggactacaggcatgtgccaccacatctggctaattttttttttttagagatggggtctctctgtgttgcccaggctggtgatttttataatctagaaagaaatatatcacagtgccaaaaaaagttgaaagacttcactgtggtttcacctcctgggagatgagtgttggggaacattaacagccaaggagaaaataagcacagcagaaagggtttgggtttaggtgatactaatctatgatgatagtccttgctctgcccttttcaggctgggtaacatggaacaaattgcttatcatctgtaaccctaaattcccacctctaattggagaataataaaatctaccctaaaagtttgctattatggctcaagggtcaaaggcaagttccctgcctcaaagaagaatcagataaatgaaaacattgctgaagaaaatatccagaatgaatcttggagagacataattatggaattaattaccaaaagagtgaaagagagaatttaaaaagatgtggtaagcgca

SEQ ID NO: 9998 - DNA, 1210 bp, artificial
  synthetic oligonucleotide
cctagccgctctcgccccccgcctcagccgcccagccccccaagctgaccaccattttctgcatcaagaagggcggagcaggggtgttggaaaagcttgcgctggtgacggaggcaggtgcttccgaaaggtcgtagcctcaggatcgccggctcccgcggggccgggcacccctccgctcacacaaggctcgcggtcccgcggcggggccccggggctgcatcgtggaccggctgcgtctccgcgctgctgcccggggatggggcatccgcaggccggggctgctcccccacaccaaccccagggaccccctccgggtcccttacctgctccccctccgcttcctactttcggggccgtacctggcccgcacgtcctcagggacaccgggaacaggtaccactgccgagaagggagcgagcgacggcggttctgacgccacaacgaggtaagactcagtgttggccgatcacgtgtggctgttgtcatcgccagaggctccgcccccgtcccacgccccctcctgcagcccggagtcaggtggtgctttcgggcccgcccccatcctcaccgggagtcccttttaacatccccagcctgggctctgccactcttccttctctgtatattcttgagacttcccctgcttgcccaggaaggacggaaggtatcttctcagggagctgttggccattcccacttctctggggacttgcctctctctgcccttggctcccaggattcacctccttctgcctgtctacctccttctgtcctcctaccaatattctccgttttctctccactaaaatgagtggaagaggtgtatcaggaaaggagcacaagagagtaggcttttctcattcttaataccttttctgtattatttcttttgtaaaacacaaaaaattaatatacttctttaaaaaggaaaaaaagttatttttacttgaaagacgggattaaagttgggcaaaatgtcccaaccacctgtcctgttaagtcattatataaatatagactctacacgcagctgcttttttagaacttggaaaaggacagggcagctgatggctccccttttgaggggcccctggacacatgaggcccttctatgaaatgagctagtgagttgtagtgctacagaaccttgttgggttttcataactaaaaggaaaaaaaaggcctttttcacaaatttctggttcaa

SEQ ID NO: 9999 - DNA, 1045 bp, artificial
  synthetic oligonucleotide
caattctatgagcatatgctattattcccttctttcagatgaggaaactcaggttcacaatgtgtacctgacgattaattgatgattcttcaggcagcacagcttcctggtaacaccaccatgaggactctggaatgaaacattactcttttttaaaaaattctgtatcattttcctcacaaaacttctaatatcacaacagctttcactttaaaagcacttactatatgccacatgtacaataagcactgtacatgtattaactcatgtcattaaagtaattttttctttgtcttttctgactataaaaagataaaagttgcccagtgcagtggctcaggcctgtaattccagccctttgggaggttgaggcaggaggatcacttgagcccaggagttcgagaccagcttggggaacatagaccctgtctctacaaaaaaattaaaagactagctggacatggtggcacacacctgtagtcccagatacttgggagtctgaggcaagaggatcactcgtttcgaggagtttgaggctgcagtgagctgtgatcgcaccactgcaacccagcctgggcaacagagtgagaccctgtctcaaaaaaaaaaaagagaaagaaagacagaaaaaagaagagagagagagagagagagagagattaaagttacctttttaaaaaggatatagaagtacgaaaaataaaaagtaaaaattgcattcagaaatctcactcttgttccagggtctttttttgttgttgtttcacaactgctgccaaggccaccctgctctacaacagctaagaaccagattgcagaggaaatggaggctagaggagggacgactgatggaggagttatcctgggagtggaagaatggaagagacaattctcgaaagaagtagaaaagttcagtagctccagaaaaagaggtagcccctccctagtaatcagagtcaagcaaataacatttttcccgctgggataggaaacaacagaaaagactgacagggccaaatgtataagtggggggcggggagggaga

SEQ ID NO: 10000 - DNA, 1977 bp, artificial
  synthetic oligonucleotide
cgctcttggcaaagtcgggtaccctctttgatcagctgtcacacctggcgataatggcatcagagagagataccctgcgaggatgccgtgagatgcgccaggtaaagcacctggggtcagaaagccaccccctcctcctcttctccgtgacccccctttgctacacaaacacaccccgaccccgaccgtccccagcctcccggtccttcggggttggatggtgaggtgggtcaggcaaggggggccgagctcgggtgacgcggcgctcacgtgacccgccgggcgcctacgtgggcaccagcccccgcgcccgcccgcccgccctgcggtccggtcctggcgcccgcgcagaaccagctgtctgagctgcccgggcagcgggggagcagcgagcgggcttccgcgagccggagaaggcacaggcctgtcccgggtcccggcaggtcagtgtgaaggtgggcgctgccggcggaaccacggaaggggtggaggtggctggcagtaggagtagggaggggcggagaaaggatccgggagactggtgaggagggggaagcggagcggtcggaggcaagggcgggggagcctggcccgccttctcgacgaccccctgcactgagccgtccatccattttagtactggaaatggagtacgggggggcaaccccgcagtgcaacagtgaaacgtagacatattctggaaataaccgcctctcacaatctgctcccatggaaacatctgacctccgcaaaaacggggtggcgctgggacaggttgcctccaggggaaggggacacagagacaaacgcagtttggaaagcatcctggtttggtgcccgaggcctggaaagaaatggcggctggggtgcgggggatgtaggggaggaaaacgttgggtaagcagggcctggactcaggaaagggaaccgagtccctgtgagaccgctgactgcgcagcccctacccctgtctcctgtctgtccgcaggtctgcgcgtctgttcccagcgctctgcgaggcctaaaaaggaggagcaacctgtccagaatccctgcaggtctgtgaaggtggttgtgggggagctcaatggacagggccctataagggttgagagtgtggagggcccggccagggccgaactggggcccctgcccatcccccactcacatgaacacacaccttaccaggctgaaccagtgcagagaaggtggcagggactgccagggaatggctggctcacgtgtgtgggaggagtggcaggctacgtggtgggcagaaggccctcttgggggccctgccagcttaggggaaccctcaccaggggtgagatgcaagtactatccagacctgcattccaccccatgccctcagtctcccatgtctcttatttgtctcctcttccctccattcccatcccccaggacaggaaaaggaggggaaatctcgacatggaaaaaccctacaataaaaatgaaggaaacctggaaaacgagggaaagccagaagatgaagtagagcctgatgatgaaggaaagtcagacgaggaagaaaagccagacgtggaggggaagacagaatgcgagggaaagagagaggatgagggagagccaggtgatgagggacaactggaagatgagggaagccaggaaaagcagggcaggtccgaaggtgagggcaagccacaaggcgagggcaagccagcctcccaggcaaagccagagagccagccgcgggccgccgaaaagcgcccggctgaagattatgtgccccggaaagcaaaaagaaaaacggacagggggacggacgattcccccaaggactctcaggaggacttacaggaaaggcatctgagcagtgaggagatgatgagagaatgtggagatgtgtcaagggctcaagaggagctaaggaaaaaacagaaaatgggtggttttcattggatgcaaagagatgtacaggatccattcgccccaagg

SEQ ID NO: 10001 - DNA, 919 bp, artificial
  synthetic oligonucleotide
tatttcctatttcctacctgatttttttagtcttagttcccactgctgcccaataagtaagtatcatatgattaatcaaaaattgactattggccttttttttttacactaaccatgcctgtggctttgtccaatcacatctacattagttcatattaatttcgtgaatgaattggcatgaaatactgacactgactaaaataccataaaacacaaaatataccactacaatgaggacattaacattacactgatttgtgtatgctattgagtataaagattagtatctgcacaagaaaacttgaagtgttctgaattcttaaacttgacagaggttgacagcagtttccacaaatttgacaaaactaaaaattcatccatcgccaatgataagttgtaaagctgaaacttttatcaataataattttaaaattgactatgccaaaggaaagattggagtatcttttttttctagaaaatatgttattacaaaaaaaaagaaaatatgttattacaaaaatgtcataagaagaaaagatcaaagaattcgtagccaaaaattgtagggaaaaaaaaaatcactgtagaggtatgccaggcagttaattaagacaatgttatttttctggaaatttttaaaaaatatgtcagctgttcaattttgtaatttgttgtgatttctcataataagtaaatgttgacttttgtacatagttgcttgaaatgctcatactttttaatattctttttcttagagtcctccgaattataaatttcattacccacaacccgaatctgtccctgaggtcataaaaagtaggagcttctgagttggaattgcaaagggttaatagggatgtggatgtggttgagaactgggaaatatagcaattgtggaagttgaattaatatcatttgt

SEQ ID NO: 10002 - DNA, 1421 bp, artificial
  synthetic oligonucleotide
cccccgccaagtcggtgtgagggtaggaatcacctgcaaacctctggaatggaaaacggacaccgcagcgggtcttgtactgcagttcccacagccacgccccctgcccattttgattcagaaaatggtgggcagtggggaatgctggggagatgagcagaaaccctgcatgggtattagcttcctattgcagaggatgtgggagttttgagcgaaacatagaaaaagaggtatgcaccccggatgcctgaaggtgggcatgagagtggtgggtgggggcgggtgcccttctgaaactgcattctctacactcctgccctgcctcctcattcccttttggggaaaaaaatatctcagcagcttaacacagcaaacgtttatttctagctcacaataaatgccgaacatgtgttggtgaaggtgtggggtgaaagggccctggtccccagtctctcaggacctcaggctgacagaagctctacagcctggaacatcactgatcactatggcagggggagagagtaatgggaatctctcatcccactataggttagtctagaactaacatgttactgcggttcacagctgattagctaaaactatcatatggtctcacctcatagcaaggggatagaggggacaggggattagaaagtatagttttctgtgtagggtgggtgtaaagtgagaaaaagaaactataataaaatattcataagaattcaaggggagaatgcctttctaaagtactaaagcgaaacaaaaaattaaaagttctgaagaaaaagtagtaaatgtaatataagaaaattaagcttctatggagcaaagcaagaacgaatgtgaccttgcttttggttttctctgtgatgccattttgggagctcttcatgtctccagaccattcttcaaggccagtggcagtgtgatgggtgttagtcaaactggaattctgtctggagtgagatcaggttccaggctcactggaattagttttataagagaggataaatccatccccctaacgctaagagtggtggtgcttaggcaggaggtggaagggctcactcaggccacattcccctctggggtgggtctgacttttgtttctctgcctgcagcaggcacagggcccttttaggctaatggccaagctgccctgcacagacacacctggaggaggagaaccgactgccctattgcaggtcagaacactttgcctttccctcctttcccctctctcttttggggaacattttgtaggggaggagataaagccccaaagtgtcctggcaggaaacattcattgggatagtctttgagcaagcagatgtctgaacagatctgaccaggtaacttgaggttgaagcagaaggggctgacccttctctcagagtccagttagcccccaagaagactgg

SEQ ID NO: 10003 - DNA, 918 bp, artificial
  synthetic oligonucleotide
aacttagttgaggcaactatttctttagaacttttcttggtgctatgaacagaccggcttgagactggctttggggcacctttttagtattatataatgtacctaaatcctacctagtcttgctctgctgccatgacttacgcggacctgatattgcccattactatgatggtcgtttcctgcctcatcctggatcctgactagatctgtggtagtatcactattatgttgatgtcactagcacaacctttttctgactattctgtcaggacacttcagtcatcctagattgatgaattaggagaattattatgtcattgacaaaaaaatttataaagcaggagtggagggagaactgcttcaaaagaagttgctgagtttctttgtagacatattaaatgacggtgggacatatgagtagaaaccaccagcagatgctgcgtcatttttgtctactgcctggcccctgtgagaacctgagtttgtgagcactggctataactgaatccttgggaaaaccccagttaggggactggaggagaaagaggattgcttaacaagatcaagaagaaacagttatacaggtgagatcctaaagaaggagacactgcaataaatcttggataagggttctagaagtaatgggataagagcatgagtgaaacaattagttttggataagaggaagaaagtttccagtatctaattagagacagagactcttggagttccaaagatgcctagcccatcactgtcattttccaggcttgtggtatattaaaagaaaataataaagacatgtcaaaacaggatctaaacattgtgagatgtttaaaatgtttatacttaacatactgacacttctatcaccaccaaaatttccacataatgtaatataatatatttacaaaacaaaaa

SEQ ID NO: 10004 - DNA, 228 bp, artificial
  synthetic oligonucleotide
atatagatttttagatcttaaaggaaccttaaaacctgataatcaaagctaaatctggtaattcagattctcattttatcacaggcagagaacttctacaaatttatgttactagcctagactcaagatgagaaatcaagtcctcttcagagttctccaaatttgcctgatcatatgaatcacctgggggccttgtgaaatacggataaaacaaattctatccacctg

SEQ ID NO: 10005 - DNA, 686 bp, artificial
  synthetic oligonucleotide
aaatagagctgtggttgacagagagaagcccatttaagatgaggaccacatttgtcttctccgctgcattgtgttgtagggcacagagatgggctctggatacaggcagccctgggtttgaatttcactctgtcacttcctagctttataaccttggccaagtttcatcatctcgctgatcctcagtatccttatatgtaaaatgattgtcatgaaggatgcatgagacaaagtatggaaagtgcttagcacagcacctggtatataagttgcttcataagttatattagcagtttcattttttaaaaatgagataataggaataaaggcaagataacaattaaattgttctaaaggctgcaattggtctaatgaactgggttatctacagaatgcattttggactgcttgtttggaaggcagcaaagaagagttttcatgggctttggagttcgacatccctggcctgcagtctcagtgcctccacttacaagttgtgaagcctgacacaagttacttaatgtccctgaaattcagtttccctttctgcaaaatgggatacaatagctgtctcaacagggttgataagaagcttaaaagagataacagacagaaagttcctggcacaaaggaggcaggcagccaaaggcagctattattgtttcaactgaaagctttatctccaa

SEQ ID NO: 10006 - DNA, 1820 bp, artificial
  synthetic oligonucleotide
tttataacaagctctccaaaatgattctgaggcagctcaccttgtactcacactttggttaatagcatgagttctggattcagagactcagttcaaattttggcttcaccttgtattttcagacaaatcattttacctctctgagcctggcctctttggggtcacaaagggctgtcgaaattatgttgcttttataaaacaggcagcttgttgtgtaaaaagaaaaaaaaagaagaaaagaaaaaaagattaataaaaaaaatgaaagaaagaaaagtaccaagaagagtttcctcttctgtacaatgggcaccataaaggttgccctcatcttccctcagccctctccccactacctcctcaccccctccctcagcactattatcacattgagactgctgttgagatggtttgagactacctgtgcaaaaatactctccaggcagcgctgcagggcaacgaattagcatctagagagcaacagacggtgctaggttggatgctgtaacttatttgctgcaggatacaggccaaaactagtaacctgtctctctctggctcagtttcttcatctgtgaaatggagataatggttcttgctcaccaattctatgcaatcccaagttggtcctcccatctggctttggtttttctccactatcccttaatctgacagaatagaggagtgctggcaaggggcagcctttgaagtcagacatggtgacttgggtgtgagctcttaactctgcacttcctaactgtactgcctgggtgcttcagtcctttcctgttaaatgggcacactactacctccttcacacggctgctgagaagaggaaaggagatgtccatgcaggcgcctctgcacacagaaagcactcagtaaacgctgtttccccgcttccccctatacaaaggtgaggaactctcattgttcacttggtttctgtcccacctcgtgtttaaggtatccggtctaaaagcccggaggagagccgaggtgtaaggggatagggagaagggaagagatgggttagcagcaaactcacggatgaaagggaaatgggcccagtccgtgcgtccgagctgctgacgccgtgccgcctcccgcgcctgtctgccgcagcccccgcccgccggcccgccggccagccggcccgctcccccttcttgctagcagtagcttcggggccggaggctgtgcggcgaggccgccccctcgccccgctgattggccgcgtcgcccggcccgtcacgctcttttgtctcagtcgccagagactgaaagcaaccgcggctgcccggagggccgaactggagggtgggcgcagccttggctgccttgggaaccgtgctgcctcgactcggctacccctcgctgggcggtcgtgcgcactcgctaggtcgggcagccccgggtcgcttagcggccgaggaggcggcagagatcccgttcccctgcagagctacggggaccggaaggcgaaacagagctgtggacgcgggagcacatgctgcccaccagtggagcacaagtaaagaaagaacgcgcgattgcccggcgcggagaggggtgggggaagccccgccaggactgggcggcgcccggcttggagaatcagtaactgcgaggcaggggatggagcactcccttggcctggttgcgctgaggaaggagttgtggttcatctggatgctgccgactggataggatttaggatttgcctggattaaggtgggtgggggtgttgtcgtaggtcgggggtgttgttgggtgtcgggggcggggtgtgttcggggaggtggcaaggggcgggagga

SEQ ID NO: 10007 - DNA, 5219 bp, artificial
  synthetic oligonucleotide
gaaaaaaacataacatggaattctatatgccactgagactttaaactgcaacaggtgaagctattttcttattgctgaaatatcttagaggagtgagggaggggctcagatgtgctagtggtcacccctgcctaaacataaccaaagccaacagatggcaaattttggtatgggcccatattgggtctgcattctcaatactgatttcataaaataagtctactatatttgcaaagaaaaggaggggagtgtctattaaaagtgtctttgggggatattcatgctatagaatttggaaatagatgagaacactgtcatttttccttctttgtattttctggctctttcttccttccttcataaatccattgagaggcctatgcaaaccctgggagggaaaaaagcagctcagcaaacctttcttcttttcctctgagtttaccttgcttccctgagaaggcagaggatacgtcatcccaacctgaggctatgggcccctggcatcaggactccagcattcagtggtctactttgttgggctgcttttccagacatcacacccacaggcgtgcagtgcagttccatcactacactcacacacacaccctgaggcaaagctaataagcccattctaacttttatttatttatttttttgcaaatacttccttgatgcagctatggtcttctgtaatttcaaacagtcaccttttgatcccatgacctgcaaaattagtcataactgcctgagtaaatgaaaaggtattttaaatcaacacaggtaagaatcttgcctgaactgagagaaccccctaatcaatcaaattccagaaaacccaccttttcaaaataatatcaccaaaaagaataaaacatctaagatgttttttctaaggtgtttacaaaaaagcgaacattctcttatgcatttggtagtttcataaagttgaatttgtgtgacatctgcaatgcatgtgtttgactgtatacaattcttctctaatctttccacccttcttaggtaagggaattttattcaaattcttctttctttttttgtttcattttttaaagacagttttccaaagcttacaaatgttttccccattaccacttaattgaaatatgttagcaatgttttcaggctgacatcaaaatcttcccaaaaaattaaaatttagggctgccactccctactttagtactgtgttctgtgtgtgaattactccttcactccaatgcctaaatataaattcactcatttagctaagtgcttgtgctaggttttaaatattttaaataatttagtacagtgaaccttcttataaaactgagctattctgtgcattaatttgaatacttccgaggtgagactgagccccgaacatgactccatatagaagtaatcctttagggaaaactaacattctccctagaggataccagtgttagaagaaggttaatcttatttattgggatatatgtatgtatgtatgtgtatacatgtgcatatatgtgtacgtaaatgtgtatatgtacatatacatgtgcatacactatatggagagaaagacagatacagatatagaaggaagatgaaaacacatctttttttcctttaggaaatcatatttcctctgtttatgagcaatttccataatctgaagtttacacatcctattttctaccactaaagcccctactgttcaaaacttatttgtcaaccatggaaaagacaacagaaaacaccagcttgagaatgtccaggacaaaacctaaagcatgctttagaatggctgtcctgccaaattgctttttcaagatttactgacctgcactctgtcttcagtcaaattcaggcgtgctgcaagtctctctcttaggggagaaaattacaaatattcagtatttggagttgtggataaaatgcaataatatgaacgtggctcggctcagcactttgggaggccgaagaggttgctgaggtcaggagttggagacaagcctggccagcatggtgaaaccctgtctctactaaaaatacaaaaattagccgggcatggtggcacatgcctgtaatcccagctactcgggaggctgaggcaggaaaatcgtttgaacccgggaggtggaggctgcagcgagaagagatcgcgccaccgctctccagcctgggcgacagagtgagtctcaaaaaaaaaacatatatatatatatatatgaatgtacattatttctctcccccacctcccagtgcagttttctgtaatacggttgggactcgctttagggaggtttttcccattaacaacttcgctgttaaataagatagaaaaaggaaacatatgtaaaagcgcccgatggtttgttagctgaatatgactcaattcttctgtttgtgaaacagcagagaacaaccctggaaatctttccttgggaagtccgtccgtgaaaaaaaaaacaaaaaaaaattaaatgccaaaacacctttaaagcgctgtattgaaccacagtatttctgtttatcgtaaaaaggagaggtgaactctcagggagggaactccaaaccacatcggccaagcgcgccctagggaaattcttttttgctctttgccgggcgaaggctaagtacaacgaagccagaaaggtccccttaaccctactctgacctgtccaggtgccccccgccccccattccagcctggccagaaaaggcctgccccttcgtacactacgggtcggtatgaggagggctccgatgaggctagcgaaggaaaggggtcgctggctaccgaaagctcaaaagtccgccccctggttgtaaaagtgcgctccacgtggcagggcggttactagggcgaaaagagtgaggcgctcgccacgcgcgcacaatgtaaatggcgctaaaaaactcgataatcaagacaaataatattttaatgcaatattaaaacgtatcaaaattaatgcaaaaacaacccatggtgagcaaattgccaaaattttaaataaaggcgggatcccaccctgcctcactcgctttaccctagtcccgccccagtcttttacatcctccgcgccccgcccaccacgtcccccaaaaaccaagggcggaggcagcgcccgtgagccccctacgtggcttttagctccggtgaaagggtcccgggatgaactgggcgcctccggggcaagccacttaccgcgccacaacgtcgggatattgagattcatcgaaaaagttctctagctcctgcagctgaaactgcgtgaacgcggtgcggcggcggcgtttcctctctgggggctgtggtccctcagcggtttgtggcccctccgccggctgtggcccctccacggtcgtctggggcggctcctcctgctcttgcttcagctcgagcaggggcggctcctcctgctgttgctccggcttggtcaggggcggctcctcctgctgttgctccggctcgtggccgccgccaccctcacggtcttggtcgtccgaggggacggacccttccgtgccaacgttgttttccgcttctgttccgtactcaggtttggaccgtgtattctcctcgtcctctcctccccttgccatcagcgaggtcacggtaagtttctcatctgggaagggaggaaagcaaaagagacaccagggcgttggagcccacggcgcgtgggctggaggaggcaggggacccgctatggaagagcaactgcgacagccgcgcagcgtctcctccgcttgcctctcccagggaaaaattcctcttttggagttcgcgaaagctcccgtccctgtccaagcactaaccattcacttcctcgatgtcctcgccgactgccaggctgcggtagccaatatcactgtgggtgtacccgcgaagagactccatgcttcaagcgctgtcgataaagctgtgcacttctgcagactctgtgcgtggttccgcggcgatcccggggttggaactggctctgggaccaatggctcgggcgagcgcttttctggcgccgggacctctttctggcgccgtctggcacttgcgcgccctatatagcggtacggtgccttccgcaggttcaaagcgtatgcacacgcgtcggttaaacgccccctattagcattcacagtacatctagttgtgagtgcgacccccgggggacgcattcgtgtccagggcgtacgaaaaatagggcgagcgtgcgcaagcatggtgcaggtagtgaacatgctttgcggggaacagtggccccaaattgctgcttaactaactactcccaacttgagcagagacccagattggaaaaagcggctgggttgtgaaagccgatttgggggcgaggagacgagggggcgagggggcgagggggcgagggggcggggtgagacctcgcaccagcccgtggagaggtattttggcagtgttcctccgcccaaccgtctttaccccgcagcacttgggtggagcgatgccctttgcttcccccacggaaaagaccgagagatggcgttgaggaaagcgcggaaagttcagcagcccaaacatgcgaaagtgaacttgttagtctaccatgcaattgggttctgagcacgactctcccctgctagaaattagtgacaaatggataggactatctagttctgtacagttcgcgccaaagtcaggatagtgataaggtgcaatgattggctagaaggctgcttgctctggatttttgaattcagaacccaccgtgcattccgggagcgggaatttggggctgaatttgaagagcagtccgctgctcaggtgcacgctgcaagaaacccaacgtgctttttgagaaagctccaaggacttaagctttttagtaatgaacttatgtcagagtgcaagtatagaaatctgctaagtgcatagtgcatccaagaatgcttacactacgggggccccgtcttttgatgcgcggcacttgaaacgtctgctgtactaggttcctgcgcttcttattgcagcgcgctttgcagaagcccgttctgcaggctcctaaagcgcgcgtattccccgggtttgtgctgtggacctgggagagttcccgccttccccactaccccttcttcctcctccccctccctttttctagaactatcttcctgaattcttgctccatagtgatgtatcacattaaaagtcctgggctatgattgaaggctgtatggttctccctccaata

SEQ ID NO: 10008 - DNA, 1440 bp, artificial
  synthetic oligonucleotide
cacttagtctgtctggagcatagaaaggacaaactggaagtgggaaaaggaaagaagaggagactatacagggtggctttccctcagaaatcaagagttcatctgaagacttcccaggcagatctacagcaaatatctcctcccataaaacccaccctgagtccacagcaattagagaagaccactgtgatttttgctgaaaatcaaagcaaactggaggctgtagaccacatggagtctgggcacgatagttgcacagtgctattccatggaaatacatgggggaatataagtggaggaagtgtttgatattgttttgcaaataactgtgtgcccagggagaggtttgaagcatgccaggaaaggagaaaactatattgatttcatctgtaatgacctgtgtatcttgaaaggtgaaggaacaattggttttcaaagactgggctctgatgaaagtttgttacttaatataccgttttgcttctgtctttgatgtactgagcactattttgcaagaggcaaaaaacagtgcctgcatttttctttcttttttgcttgcatccagcacgcttattttcattaaattgtctctggatcctgtgaagtgaggctcatctctcccgctccgtgcagtagaggaaaaacaaacaagaactgaaagaaatggaaggtgaaatgtcaagtacctaaggcattccagtctaaccttgagcagaggccagctactgaacgcagaaggtaataagacaaattccagagtgtgtttttataatgggatggcttgcaagccatgctgacagcgggctatactctcacagctctatttatttatagctccccctccacccaaatgctacagaacaacaagtattctgacaagttggaatgctaatagattacgtgaaaagcaaatcaataaaaacccattccaaaatgtctaccttcccccagtaattatgtaggaaataggataatgggaattcttttttcaaatctagtgaggtttagggatcaggacaggaggtgaggatgaaatatatgctgtttggcctgattagaaggataggagggattcagttagatttagaggctccagacagcatctgatatttatacaagtctattcctctggttagtgcctctgggccctccaattcctgtagtctggtggtcttttagataagttctgtgtcacggtatttaaatttggagagtgctgtacattccaactaaaaacagggcaactgtgtcctggctctttaaacatggccctgactggtctaccttttctccctgatttttcatttagcaaaaactattcactgtatagacagatggggccttactggatacacgagggtgtctaataattagggacagctgcttcaggtaaatgcagtttgcagatggcaaaggaacaccagattatgctaattttcc

SEQ ID NO: 10009 - DNA, 4345 bp, artificial
  synthetic oligonucleotide
atttctttactaattctttcttggttgtgtgtattctccacctggcattccataatgtaccttatctttcttactttctttaagatgttttttaatgcatcaaaatattgtctaaattatcagggaaagatggctgactacagttagttcatcctccccttcgccaaaagtgaccaaaacaataaataaaaaactgtatttcaactggagtgactgagaaaatatggcggagagtactaagggagtagcaaaacccttgtggagcatggaagcccaggataacaccacagagaggtgagcaaggcatctttcctctgccacatggtctccccactgggattggcttagagtcagagtcttatttttacaaggaaaatttaagctagagatccccatttgtccccattgctacatcaaataccagcaatccttgctacaggagactcccccagttctcacaggccccaaatctagtttggagagtatctgggattttgtgcagctgcattgccttagaataggagccatcctttagcaccctctatcctcatgacctaaactgctactgcataaaaccatctttaaaccagacccactgctagagtgcatcctatcctgggggccagcagcccccactgtcattgtcattctactatgttaacagaagtgcctgtagcaccactaccccaaaccacaaatactggaattatagccatttcacaaatgagaaagataaaggaaacaaggtttagtaccaaagaaaaccaccaaaccacagaggtaaacaagagagtacgaaaggaccaaaggatctataaaacaaccagaaaacagttaacaaagtgtcaagagtaaccccttatcaataataaccttgaatttaattagagtaaaatttccaattaaaacatacaaaatggctgaatggataaaaaaaacaaaaaacaaaaaacaaaaaacaaaaaacaagacccaactatttccttcctacaggagactcgctcatgtaaagatacacagactgaaagtgaagggagggacaaagatattccttgcaaatgcaaacaaaaaacgagcaggagtagtcatacttatgtcagataactgtattgacttaatgtcaataactgtagaaagagaaaaagtcatcatataaaattaaagagatcatttcaacaagaggatataacaattataaatatataagcacctaacactggagtatccagacatataaagaaaatgttattagacctaaagggagagatagactgcaatatgataatagttggggacttcaacaccccactttcaacaatggacagatcatctagacagaaaatcaattaaaaaaattggacctaaactgcaccatagactgaacacacctaacaggcatttatgggccattccatcaataactgcagaatacacatttttctcaattgtacgtgaaacattctccaggatagaccacgtcttaggacacaaaacaagtcataacaaatttaagaagttgaaagaaataaaagatattcaaattggaaaagaagatatcaaattgtccctgcttgctcatgacatgattttatatataataatagaaaattctgaagactccacctaaaaactatgagaacttataaattcagtaaggttgcaggatacaaatcaatgtacaaaaatggcagcattttatacagtaatagtaaattatcagaaaacaaagtcaagaaaacaattcaatttataactattaatactacagaaataatgagatacctaggaataaacttaaccaaggaggtcaaagatctctatactgaaaatcataaaacattgattaaagaaattgaaggcaagagaaataaatgcaaagataacccatgtacatggttcaaagaattgatatataaaaaatggccatactacctaaggtgatctatagatttgatgcaatccctatcaaaataccattgacaatcttcacagaaatagaaaaataatcctaaaatgtatatggcattacaaagggctctgagtagtcaaaggaatcttgaacaaaagaagaaagcaggaggcatcacactctctggtttcaaactatactacaaagcttttataatcaaaatggcatggtactggcataaaaacagacacttagaccaatggaactgaatcaaaagtccagaaataatttcacatatttactgccaactggtttttggcaaaggcaacaagaatattcactgggggaaagaatagtctcttcaataagaggtactgggaatactgaatatccatacgcagaaggacaaaactacacccctctatcttaaaaatccactcaaaatagattatggacttaaatgtaaaactgaaaactgtgaaactaataaaagaaaacagaggaaatacttcataacattgggatgagcaaaaatgtattaaataagacttcaaaaatacaggcaacaaaagcaaaaatagacaaatgggattacatcacactaaaaggcaacaacaatctacaaaatgggagaaaatatttgcaaactatatctgacaaggggtttctgtcaagaatatataaggaacttaaacaactcaatagcaaaaagacaaataacctgaataaaaaatgaccaaaagaccttaatagacatttctcaaaagaaaacataccaaaggccaacaggtatatggataaatcgtcaatatcacgaattattgtgaaatgcaaaccaagaccacaatgaaataccacctcacttcagttataaaggctactatcaaatctccaaaagaaacgttggccaggatatggagaaaagggaacacttacacactgttggtgggattataaactaatacaaccattatggaaaacagtatggaggttcctcaaaaattgaaaatagaaccactatacgattgattactcccactactgggtatatattcaaaggaaatgaaatcagtatgttgaaaagatatctgaactcccatggttattgcagctgtattcacaatagccaagataaagaatcaacctatgtgtccaacaagtgatgaataaattaaaaaacgaggttcatgtacatgggattctattcatctataaaaaacaatgaaatcctgttatttttgacaacataaatgaacctggaggaaatcatgttaagtgaaataagccagacaaagacaaataccatatgatctcactgacatgtggaatgtaaaattataacaataatgatatcatagaagcagaaagtaaaacagtggttaaccgatgctgggtagtagactgggaagggcaggatgaggagaggtgagtcaatgggtataaagttacaattagataggataaacgaattatggtgttccattgcacagtagcatgagtgtggttaacagtaaaatattatatattgcaaactacttagaagagaggcttttgaaagttctcaccaagggaaaaaagataaatgcatgaggtgatggatacactaactaccctggttggatcattatacaacacaaatattgtatcaaaacatcaaattgtactccataagtctgtacaattacaatgtgccaattaaaaaataatcttttagtgtcttgttaaatatttccctacttcattgactaaaatattttcatctatattttctacatagaatagtgatgttttatttttgactgttaaatccttaatctatctgaagttggtttttcgatatcatatgagtcaggggcctaaatcacctttttccatatgctaattattttaccagtttcatttattgaaccatccctactttccctactgagtagatgtgccatctctctatcttatatcatgggtgagtctgtttctggtatcttctatttcattcatcatttaatcttcctgctccaataatatactgtttaatattataactttataataattcctattttggagcaggcaaataccccaaacttgctctccatcttcagttgcgttctggccagtattggcctgtttgtcttccacataaattttgtaatcattaagccatgtgaaaacactgttggaatagaaattgaaattgccttgattttatttctagatcaatttggggaaaactaacatctttaagatattaaggcttactgtgcaataatggagcacatttgatttatttatgtctttaaaatatatatcttaataacattttataattttccctgaagatgtctgtgcatcttttattaactgtattcccaaatacttgagatttctagtactataagaattgtgttttctctttaaatatagttttaatggctt

SEQ ID NO: 10010 - DNA, 1070 bp, artificial
  synthetic oligonucleotide
gagcagaattcataccaggcatttggtttcttcagactgtaattaacaactatggacttagaactatatcccccaccctagctggtagtataaacaggacacgtggacaatagcctgaccattcactagtcctgttatctagtgctgctaagactggttaaatgttctgacctgaaatataagtattttgccattctctattgttctgtaccatttattctagttgatgtcacttctgttcgtaacctatagaactctttgtagatgggagagagattttgactatctagaaatgagaggggtaattaatgcagtaaagacctttagaaggtgaaggggaatggggtccagagcccaggagggcgggctaaaaaaatagagacagttctttgattctaaaagtagggaaggaaaaaaagttgaggatacacgcaagataggtttgggtgacagtcaaggtgacttccattttgtaaactaagttagaggtaaggttgatcaactgagggggaaagggggagtgtaagagtaaaacttgagaaagtggctagaatttggatagatcctgcttttccccaaactaattgtctctatcagcaaggactgggccagctaccctgaaatgattctgccacgcagtgaccatattaaaaatcttgaaagcttcatcagtaaactgctttaatgagtagggctctgcagcactgatcccacaatatgagttggtcccattacaaactgataatgtccagcctcagctgggctctcactgtcactcaacaatccattgatgtgtcttggtctgctacttctgccattacacactaccttcactcccaataaatacattaggtggtaatacttgggctagaaaattttcagtgagatgattcctttgccatggcagggacctagcttgtgtgactatcacctaatctttagtgctaattgtgaaaaggcatgagtctttctggacttctgagggaagaaagtcttctattcttttcagttaaatcaactaggatgcaaagcagaatataatttctctctaaagtccagattcctttgcc

SEQ ID NO: 10011 - DNA, 605 bp, artificial
  synthetic oligonucleotide
tggagagttaacagaaaaatccagacttcgggtttctgatgagaaattggaagaggtggcaacatttagccaacttacatacacatggcatgatttgtctgaggctgcatagcagttcttcccttagaaatttgtgttgagtgtagttatacccagtatccactattcctaattgtatcttatacccacccattttttctttatttacatttacatatttacatattacatttatttacattatctgcctgggccttgcaagcatttgaatctgccactctggctttattatagctttccactcctcagggagaaaatgctagagacaaaaacaacagaggactggagacagaaatttagatagtacctacctgtaagtgtgagaaaaagaatcagtagagagacaaataataactgcctagaaaagtaacagaaaaaaaaccctgaattgcatagtgaccaaaacaaacaaaaaaacaaggaagagtcaggaaagaggggatgatcaacatcaggtaaaactacagagttcaagaataaagacagtgaaaaaaaagcaggtcacatgtaacccattaaggaataattgcagtgctttggtgatt

SEQ ID NO: 10012 - DNA, 565 bp, artificial
  synthetic oligonucleotide
gtctcttaagtgatgattaggtttcttgcttgtctaattggaaggattgtggtaccttttagtgacaggtccgggtatgacaaggttcattcaatcacaaatctttatatgtgctactatgtatcaggcaccatgttaggtgttagaaattcaggaatttctaaattatggttcttatctacaagaagcccacagtctagtagggaagggagtacagaaaatcaacaagtagttacagtgcaacaatgagctagcttgatagaggaatgccaagagtgctatggaagcccagaggaggagaatcacctagcaaatgggcagagttgcagaactgtggggaaagccaaaaaagtggagttgggttattttggacttggtatgcaataatttgtcagacctgttcactagacattaaattttgaaagagaaagagtccttttttttccttcctcatctcctgcttagtgtaataagcaacctggttgtatattccatggctgagagtggagacaattcctgatgtcactggctgatttcaaaatctttgcagaactattcatatgtt

SEQ ID NO: 10013 - DNA, 269 bp, artificial
  synthetic oligonucleotide
tagaacatagggcagggggcattgtaatagggaaaataacatggaaagaaaaatatagagcaagtcctcaaactcgccttatcatcagaactagctgtgggagggcttattaaaaacacagatttctactctccattccagatccactggattatattgtctagtagcggtacctagaaatgagaatttcaactagccttctaggtaattctggtaataaggcaatgtattatctagagtgatgatagcagctgtagtaagcaaaccga

SEQ ID NO: 10014 - DNA, 1525 bp, artificial
  synthetic oligonucleotide
gagagtctcataccatcaggaagatgtctagaacatgtgtaaatatttcctgacttggaggattggcagctgttagaaagaaaaacacatataaataagagcctacaaatgcccttgcttcttgtggccttctacctacaattcccagttgctgtaatggttttttttaactaccttacattttagtagatttcaaaaaaaaaattaatggcttgaaatgttaaactctaaaagctttagtaatgtttattttgcaggtcctgcactctgtgtgtgtgtgtgtgtgtgtgtgtgtgtgtgtgtgtgtgtctgtgtgtgtgtgtgtgtgtgtgtctgtgtgtctgtgtgtctgtgtgtgtgggtgctttttcagtcccatgtcctaggaaaccactgccagtctgaacagttagtcaccatatgtatatgcttgatttatgccctttcatacttaacaaaatattatactctataagagttagtggtatattcccctctgctgcactaagagcaaggaggaacatacatgagtaggaaggtgcctactaatttaaaagaagtgtgaagtagagagatgatactggtagagagcagagtctgtgtatatcccagccagtgcaatgtgaaaattggtttgactgatttcttcaccaccaccactactgcacccaccccaaaatatacagacagaattagttggttatttgatggaaattaccaaaatgtttgttggaatctggaacacatagccttactaaaatggaaaatgaatcttttacattacatccaaatgctttttgggacttctcaggcagatctgaatgtctggattcaagggaggaagattagtgaagtataactcactgtcaacctacttccctgaggcccttcagatgggatacctaggaatgaggccagaacgttccagataaacctccccccatttcctctccttttttgaatctggcagtggtatgagtgataggtgagttgcataggagagggtttacagaaatccatatggctggttaatgtatacaagaaaatttgtttaaagaaataaatagcaaagtagctattttcataattccattgaggctgagctgtaaagccttcctcactctacaaaacaggagaatttatgatttttaaataggcaaagtatctgcctctcagcagctggtgtatatagtaatgtgcttccagctccattgtaagtgctcatatcttttgagttctgttggtgttgtgaatcatcttgccatttacttgcattttatatatcattatgcacttggtagaaaactacaattcgtgaattgtattgtgaattgagttacagtaacagagatttagtgcctgaggatgtgtctctaggtttatagggaagcaaaagccatttgagtttctaatgatgccacttgccctctatttgcattgaaacatgcagaatgagatgtggacccaagcaattttacttagcctcaatcaaattttttcgttctaaaaaaagctatgagggcag

SEQ ID NO: 10015 - DNA, 2255 bp, artificial
  synthetic oligonucleotide
cacataagattagtttggggttctgcataattattctcttagtaaggtgatgcctgtatttgtcctatgcttaatgaattcgtgagagtaccacaaagagactcattttggttatctgagttatttgcaatattgtataactgaaatgagagctaattcctttccacaaaaatctataattttgttttaactccctttacttgcagactttacacagatattggaaatgcttcttttcatcacactgattgtggggtttatctttatcttaggagactgccaactagtataaaagagccaaatacttctattttttatagtcagtagagttctattttgtgagtgatattcctgtgaagaatcaaatcatttagaaaagtgacagatatgactgactggagtgcttgttaggtaccaaccacgtggcaacaaagaaaaatgccttttcaccttcatcaaaccaggatatttttttcttcctagccaaagcaggactgctgatctgagaaatccaaataatttgagattcttgtatatgttctgaggctcagtgaccccagacgtgattctagatagggaacataatgcatacaaaaagtaaatatattagagagagtagaatgattagctggaggatagctattatagaaaagagaagtttaatggagaaaataaaggaaaaaggcagcagtgtgtgtgtgtgtgtgtgtgtgtgtgtgtgtgtgtgtgtgtgtgtgtgtggagagagagagagagagacttaacaattgcatcagatattactaagtgttcccatttccaaaacattgtgtcccatctcagaaagcaagctagctcagtagctaggttaagtggcagatgtaggtgttttgggactaaggtggaaattatgcgatgtcatatgaactatgtacttggactcagcaaaaagcctttgctttaggtttagaatttttagtctatgttgttgttgacaacatagagacagagagagagagagagagagagagatggtctgtcaaatgagaaggcagatgcttctgagatctctataaaatgactaaatatgatcctcatgtggctttaaggaccattttgaaagaactgctttttaatgaacattttttatatgggatgatggcactttgcattgcatctgcagaatccttcttctttttttttttttcatatatagtcagtttaaggattgtcctgaaaacctgctccaatttcctcaaacaagtaagaactcacagaggttttaaaaccactttaagtgacagaagataaatgcttacagtataattgacagattcggggcaaaagaaagtaaaaataatgactcatgttctatcctttacagtggtacttttgtgatcgatatgctaatcagaaatggttataaggaaattcagttcaaataggaaactgaacaaacccttatatttatgccagtagacaatcataagggtcaaagggatcttgagaagtcatctggtgcagctcttgtcctcagacaggacaacttctgacctaaaacaaaaaaaagctactttaagttgctagaatttgaaagacagctacacgtaaaataaattacagtactataagaacatgatactttagtttgtatattaaggatattttgagagtatgctaaagactgtcatataacactgatattaaggagatcaattactgtattattctgtctacaaacaactgctttgttatttaaaactaattcagatccagatttccccaatttaaattttatgttttcttaagttataataaatgtgttcaaatcattgctctccatttccaaacaaatatgtacaggcttaacaattgcatcaggtattactaagtgttcccacttccaaatcattgtgtttcatctcagaaagcaagctagctcagtagctaggttaagtggcagatgtaggtgttttgggactacggtggaaattatgcgatgccatatgaactatgtacttggactcagcaaaaagcctgtgctttaagtttagaatttttgatctatgttgttgttgacaaaaatatcatttttaataaagtagtcacataggtgaagaaattcaactctagatagactagatctgttacttgttcccaaccctctggagactgattttccttatttcccttatatctggagttattttaattctagtctgaaatttgacttataaagtcttcttccaggataaccatttttcttagtcaactta

SEQ ID NO: 10016 - DNA, 1375 bp, artificial
  synthetic oligonucleotide
gaaatgtttatccatggaggaacgaaagctgggggaaatgacagatattttcaaatatctgaggattagactgcaatgagattacacttgttctgggtgacttcaaagggcagggctgaggcccatggctggaagctacatggagacacattttggctcaatcaaaggaaaactttctaacagctcagtcaccacctaacccaagggcctggcacggtcccggccctcaataaacagaggtttattatatgaggtgaaatgagttcagtgaaatgtgctgccttggacttgagagagctctctgtccctgaattttctaagtgcaagatagatcccaggtcctgaagagggaaatcttgtggggaaagagagggttgctggggagccagagcatctatcagtctctgagagttcttgctaaatttaccttcatgagctaagcgtttccttgtactgactgcatcactggctgaaaggaggagtgtggctcagagagggagccaggctgaaaagactgggctggaaggagatggtgtgcaaaggaggaagaagcacaacacctgttgtcacactcaaggatcttttccacctgtaagtggcctccgagaatcagcagaaggaaggagggagagggctaagaggcagatattcctcctgagctcggggctcatgcctgaccagactcaaccatgccacccatcatgccacctcccaccttgaacttgtgttccttcagtcaccaccttcacgttaggagctgtccagtcccttcactcccctgagcagcaggcctcagggttccacttacacccagctcccagcatgctctcctggagcccagggagccttcagacctgtttccatgggtctttgtcctccctacgcaatggctctgtcttgctacctcctaggaattgcctcagcctcatttagcttgtgggacatgaagccgctggctcttcttgttggcttttccccggcctgtaagatttaaggcctgcaagtgttgctaggcaaaagttggctgttctccttttcacttaaaacaaaacaggagtaaactggtcagcagggcagcagaaaaggtatggatcaaccaagatggagaccttcctatcagagcaattaagatcttacctctgttcccctaacagccctatagtgcttctgggttctgccagtgattgcttttccagacctttctgagagtactggggctagcattgcctagctaacggacagacaggaaaggaaagtgccatggactctgcctcaagcttagcgaaggagacaagacccgcagagagaagacagactcgatcaatctcagttgaccccagcgcccctcagtcatccttgagcatgttcccttgtc

SEQ ID NO: 10017 - DNA, 1325 bp, artificial
  synthetic oligonucleotide
gagttctactgttgggcaaaaagtttaacttaaaagtgacaaactgatatttcactaaggagatgaatgggcaaagtgtggaagatgcaggctagtttctccctgatgcttataataaaataaaagaggacagaggaaaattgaagaaggaactgttaagaaaaaaggggacaacacttgatgattgggaaaattctcagcctatacagatagcgtgctctggaaacagggccaacagtatagatggacaaactttcattgaagagattaagtgttagggtgttaggatccaatcaaccacctcagcagaagccaggaatacagatggggttatctaggaagaatctgtagagaaacctcatgtctaatggtgtaaatctcttgacatatatgagactgacaatgtttttgagaatcttataccagcaaaaaccaccagtgccagcctggtgtgaaagagacagagacaggacaaaggaaggatgattacaagagcaaagccacagacatagaggccagagaggatggggctatagctgccctgatagactgagtatatgggcccagtggacaaagcactgagcccagaatattactcataggccttgaaaactaatggaatttgccatgctaggctacaaacttgctttagaccagtaacccctttattccctcatttttgccctttcagaatggtaatgtctaccttatgcctgtcccactattttattttggaagcagataacttgttttctagctccaccagtctctggatggagagaaattttgccccaggatggaccatatccagaacctcacctatacctgatatagatgatttagataatgagacttaggactttttgagttggtatttagatgatatttgggactcagacttggtgctggaatgggttaagacttttggggatgttatgtattttgcacgtggatagatgtgaatttttggcaccagagggcagactgtactaggttgaacagtatacctctaaaattcatgtccacctcaagccacagactgtgaaatatttggaaatagggtctttgcagatgtagttaaattaagatgaagtaatactagattagggtggggcctaaatccaatgactgatatccttttaagagagcactgtgaaaacacagatacatgagaatgctatgtgatgacagaggcagagataggaattatgcatctatgaaccagggaacaccaagaattgctggcaacttaccagagctagaagaagtaacgaaggatattctcctagagcctgcagagagagcatggccctgctgacaccttt

SEQ ID NO: 10018 - DNA, 1408 bp, artificial
  synthetic oligonucleotide
acatcatatacaggctccagagcttgactgtctgaattttaatcctggctcaaccattaacaagtatgcgactatgagcagattataaaatctctatatgctcttgttttctcacctataaaatgaaaatgaaaatactgcctacctcatagggttactgtgaggataaatgacatgatgcttgtaatgcattgtcatcttgctaaacatacacagattacatacacagtaattgcacaataagtggtagctattattagtaatagtaatgattctattataatgatattcagaaggtaaaggtgtgctgctgtttattcaacttcctaagctacagaaatctttctcttgactgttccctcaactcagtcatttagctaactttcaaatattattctaaagttatccaagcaaatgtcttgtacatgataaataaaatgaaacacatgcaagtttttaaataaataggcttacctaacagttgaagtataaggtacaaggttttcaaaccctcttgataacagttggttttggttcacagtaaagccactggtgattgtggtagtagtgttggtggtgaaagtggcggtggtagtcgttgaagttgtaactggaaaataaagtgtataatgttagtaagaaatgagaaatttgtttcatttaagccttgatcattcagatttaaaattatggaggcatttttaaaaatacaaatttgaactcaaagatgcagatttgaattcaacactgttgtaatatgaaataataaatggcaggccaggtacctggattaactttccagctgaaaatcctggataaattcatagaaaaataaaacttctaaccagcccaataaccatgaaagaaatcaaatcaatcctcaaaattcttctcataaaggaaactccagtcccagatgccactgctggtaagttttatgaaactttcaagaaaagaataattgcaatttacaaaagatctctgtacatctatatctttgcatatttacatgactgtatctgtgtaattaattcctagaaataaaatttctagatcaaagtgtcagcatgctctaaattttaacataacttgccaaattgccctatctaaacaattttgccaatttatgtccctatcaataggaaagagtgcctatttctttataccacagccaatactaggcatgcatttttgcaaaccctagtcaaaagcctctcaaagctttatctacagcccagactctctcctatatgtctttttctgttacacccctattagaatgtcctgctctctatagataaaatcctaagtatacttcatggcttgactcaaattctttgttccccatatttatcacccacttctctcctactcatagtttcctttggttttctaaatttctgcagca

SEQ ID NO: 10019 - DNA, 1666 bp, artificial
  synthetic oligonucleotide
tagatggtccaatcatgcctctatttatgaagaccccaagtactcaggttaatgtgggaaaatcaaaggctctgtctggaaaatgttgccattagcattggcctagcaaaagagaaggagagaaagaaaaacaaagggcctaaaaaatttattttctaaatacaaatctcaaataaaagacagtaatatattttgtttttactgaaactcttaaattttccttactttaagtttattcttggcctatttaagtgacagtgccagattcaaacattttaggcagtgtggctccagaatcttctttttcattttttattgttattattttatttatttatttatttttgaaacaggatctcactctgtctcccaggctggaatgcagtggcccgatctgggctcactgcaacttccatctctgggactcaagcaatcatcctgcctcgggcccctgagtagatgggaccacaggggcacaccaccgcgcccgtctaatttttgtattttttgtagagtcggggtttcgctatgttgctcaggctgatctcgaactcctgagctcacgtgacccgtgagctcaccttggcctctcaaagtgtttgcattacagacgtcagtcagccaccatacccggccagaatcttctttttaaaaatcgctacactgtactatccaataagtcagggcaaaaggaagaatgcactccaaggtacaaaggcaggaaattatagagtatgtttaataagcagtttagtttttaacagaatatgtaggagaataatagaagggaaggacagaaaattacgttgggactatatcctgaaggaccttgattgccagactcaggatgaacttaaatgtatatcacatttagaaataaaagatagagctataaactaacactgcatagttcattgtagtgaagatagttccctacaaatagttctttgtagttcctaaaaagtcctcctgttttagtttttcagctgtgatccacttgtgtcaaatgaattttaataaatgttttttaataaagttgaataagttattctaaatatgttagacttcttaaaaagctagtagaatcttcctttccattgaattttgaatgtttttttctaaaaattcacaaactgtttttctcttttgatactttgaaccatttaactagttagtcacaaaatatttgggattcttttgtttatcaaaatacaatatcaacaaacttgtcatgattgatttatttatttttgttgtcatgatttattaatttgtgtttacagattattattacatttgatatggcaaaaatattttggctaaagtggtaattttattattatatttctattttaattgagctatagtgcaaatctatggcattttattccagcataatttggaagtccaattgtactttaagaagtctaactcctaatatgcttcagatatataaagtgttactaagaattattgtgaataatttaacaaaaacaagtgtacacgttccaaggaggaccatccccttcgaagtagtcactttaggagactaatctatttactctaatgttgttgttattgctaaaattgcttttgaaacttctgttttagaatcaccttgaggcatgtagcacattcttttgaatatcctcaaagaagaaaatct

SEQ ID NO: 10020 - DNA, 781 bp, artificial
  synthetic oligonucleotide
aagaagtctttggtgatctttggaagagagcagcttcagtggcatggccaacaccagattgaagaaagctgagaagtgaagaggaagtgaggaagagaagccagcaaatatagattgttctttgaggaagtttagtggtgaagaggaggagaatgaggaaatgatttttgagaaggaggcaggatttaggggagtttttttaagacaggagagatttatgtatgcatttcagctgatgacaagaatccatgcattcatccatgtaatatttatttagttcctactgtgtgtcactagagctaatgaacaaacagtaaaaaaaaaaaagtagtcatggtgtgggcccctaggtggaggcatttttggttgtcacaatgattacagaattttttgtttttttgagataaggtcttgctctgtcacccaggctggaacgtagtggcttgatctcagttcactgcagcctcaacctcctgggctcaagcgatcctcccacttcagcctctctggtagctaggactacaggcatgcaccacaatgccctgctaatttttcttttttattttttgtagagacagggtctcattatgttgcccaaactggtctcaaactcctgggatcaagcaattctgtcacctcggccttccaaagtgctggcattacaggcatgggcccccatgcccagctgattacaggatattattgtcatttagtattcagggccagggttgccttaaatcttgcaataagaggtatagtcctcaagaatgaagagttgtcc

SEQ ID NO: 10021 - DNA, 1820 bp, artificial
  synthetic oligonucleotide
tggctgaaattattaatagtgtggtcacgaaagccttcactaagaaggcaatatttgagcagacacctgaaagagatgaggaagtgaggttccaatgttagaaagggttttgttgttgttgttgttgttgtcatttgagacagggtcttgctctgtcacccaggctggagtgcagtagtgtgatcttggctcactgcagccttgatctcctggactcaagtgatcctcccaccccagcctcccaagcaaatgggagtacaggcgcgcaccaccatgcccagctacttttgtattttttgtagagacggggtttcgccatgttgcccaggctggtcttgaactcctgagctcaagtgatctgcccatcttagcctcccaaagcactgagattataggtgtgcacaccacacccacactagaaaggttaatctaagtgaatatttaaaactccaagatttaagacaggaggtaatcttagaaatatcaataaagaacaagtaactattcttagagaaatcaggggaagtgtcccaggaattagtaaacgattccagcaagatgggtaataggtggtatcgtgtaagaacatgagtttttacgttgtatatgttttaggtgtacaacatgatgttttgatatacatattctcagtaaagtgattactacagtcaagctaattaatgtatttatcatctcaggtagtatcttttgtgtatgtgggggataagaccacctaaaatctactcttagaagagttccactacttggtataatattaactatagtcctcatgctgtaccttagagctctagatttattcatgctaaataacccaagtttgtatcctttgacctgcatctcttcatctcccaccccacctctagtaaccaccattcttctctctatttctatgtattagatattttttaggttccacatttaagagagatcatgccgtatttttctttctgtgtctggcatttttcacttagcataatggaggacatgagttttttttttaactggaagaaagggacaggcccagtgttataaaggaaataggagagaaaaaaaaactggcgccaactgagaagactataggggaagcagtgtaattggggagatccagatttcagttagattaagaagctgagaatattcaaagaggctaaagagataagggatgatgtactatgtattccagaggacctaatggaaaaggctcaggatttgatgagggatggaaaatggagacataataggagatatgaagatccatatggtagttatgtgataaggaatgatttgggagtctgagacttcttgtggttattgacaaatagagttaaaagtataatgaatttagttctggtggtctcaagacaggtagtggtggtgaggctatgattattttgggggagagggtgagtgccagtggagatgtggatgcctgtagatgaatgttcttactgcagagtgagttgactcctgtggtggagaggaggtatgcatctatgaagcatttttaaaaagacaggtgtggcaatatagtactggactgtttaaaaatggtagcattattgaaatttatccatcaatttaaaaacatgacctattgggcctttgccctagttttgtacaatacatacctctatatttttatccttcagaggtaaatatttttataatttcaaagcagagatctaatgcctttaattttttaaaattttcctatagattatcattcttcatgagagtttttataaaatacttagtatggctgcagtggaaaaaaatatcttatacatgtttctgtagtt

SEQ ID NO: 10022 - DNA, 756 bp, artificial
  synthetic oligonucleotide
ccaattcaccagcatagtctgttagctttaattggctttatctttagaatacatactgaatccgtatacttttcactgactccattgctcccatcttagttgacaccaccatcatctctcacataaactaatgcagtagtttctcagcagggcgcagtggctcacgcctgtaatcccagcactttggaaggccgaggtgggaggattgcttgaggccaggaatttgagaacagcccggccaacatggcaaaaccctgtctctactaaaaatacaaaaattagctgggcatggtagcatgcgcctgtgatcccagctactcaggaggctgaggcacaagaattgcttgaacctgggaggcagaggttgcagtgagctgagatcgtgtcactgcactccagcatgggtgacagagtgagactctgtaaaaacaaacaaacaaacaaaaaacaataacaaacaacaacaccaaaaaatatctaatgtagtagtctcctctgtggtcttcctgcttccactcttattccctatggtccattctctacacagaagtcagagggaggcttttaaaaggtaaactgatcctgtcaacccccagatcaaaacattctaatggctttccatcacaattagaaaaaaatacaaagttctgagcctaaccttcaaggccttccacaatttggcccttggctacctctctggcctagtatcccaccattcttcctttgctcacctcattttactggcatttcttgctt

SEQ ID NO: 10023 - DNA, 926 bp, artificial
  synthetic oligonucleotide
acaaatatttactgagaattgccaattgacagataccttgttagggactatagatataaaagtaaataaagacacagtctttgtcctcacaaaactcacagcccactgggggatatctgtatctgtaactcaacagataactacaatgcaatttagttactgcatttcctgaaagatacatgagtactgtgggtccctggcagaaaagtaactaatctagactttggaggaggtagtacatgagcttacccttgaaggactaggagtaataggagtaaattagataaaggggaaagaaatgggagcatgtttcagggaaagcaagcctcttgtgcaaaagatcagaaacttgataagttcaacaaaccacaaagagtagttagttgtggctaaagcgtaggtcatgtgggaagtgttggggtggggtgagagatgtgacatatggctggggatgcaagagctgggtcacgtgtggagggtcttgagcgctgtgctaagtaggctgacctctacccagtaagcaataggattgcattgatgtgttttaagtacaggagtggtatgatctcattctcatgttagagaatggttgcagggtggagaatgggtggcaaaagggggaaaaaataggactagggagatgagttaggaggcttgtgtaataaagtaatgcaggtaagaaatgaggatgacctggactagggtagtgattatggatgtgaagacaagtagatggtttcgagaggtttgaagacgttagaattgacatgaagtaatgattagttggacttgagtgctgagagggaggtatcgagcatgacttctaggtttaatgagctaggataaaaagggaatagacttgggaggaatgtgaaaaatcagtgtgtactgaggagttcccagtattatgaacctattcctcatcc

SEQ ID NO: 10024 - DNA, 1063 bp, artificial
  synthetic oligonucleotide
ctggaacctctctgtggccagattcctggggccgggtgaattgtcaataggcaactgcagtcactcagaatctttctagaatgagtaactcaaagacaggggtttgtttgatccattttgaactaccgcagcatgtagctcagtctttggctctcatcgggagacttccaagtaaactgaaaaaaggcaggagctgctgggtcaactggcagattcatccaggtcacagaaagatggggaattgtaagagaagaaatgaacactgaggccatttctcttaagtggggagggcttggagtagaaagcatgaaaaatgcccctcctgtgctgggctcacttctcagggcctaggacaaaggcaggacatggtgttcctgctttcacagtgattgaaaaaaactggtggcagcacacagcttgctgccgggcagacagcttgagtgtcttcactactactcttggtggttcaagggcaggtttgcctcagcccttagaacacagttccctggattccttggccctcccacatctcgagagcagcagtaactacttcactgtgggctgtgaggagtctcttagttggacaatgttagtatatgcaattgattcagagcctaacttcatttcttcctaacttctaactggtttcttccaagttcctacacttggcctggcttccttttccctgagttggtcatcaagtacccaaatggaatccatattctataaattcttcctctccgatctctggaggcagtagagtagtgcttaagggtacatgctctggggtcacactgccagggttcacagcccaactcttgtttgccagctatgcacccttgtgcagtttacttacctttctgtgccagtttttcatctctataatgagaatgacaatagtacttaactcatagatctgttgtgaggattaaatgagattgtaatgagcctggcacctagttagggttcagtaatattagctattatttggaatgaaaagtctttctttccctcttgcacacccctgcttctctagtttcagatacttgttcctcctctcccc

SEQ ID NO: 10025 - DNA, 651 bp, artificial
  synthetic oligonucleotide
ttggccacgatggctttcacttccagattctcactttattctatgtttagggattctctctctctctctctctctctctctctctctctctctctctctctgtgtgtgtgtgtgtgtgtgtgttcattttaaaggttgagaagtattgccaattaccatctgtgtttaccttagtatagattcatttatcagattatctaagactaagactagggatggataaattttgatggggggcagaaattgctttcagaaaacacccaaagcctgaggtgctgtccaaggaagggcactcagagaagatctaggaatcaaagggcttattgaagggaggtgcatctctgcatgctggaaggaaatcttgtcaacccaatacttaagtaagtgaaatgggcagaagcaaggaaggctaggaatcaaaacagccagcttccctgggctgttttaaagagacctgggctttattaatgtaagtagtggctgcatgaccccagtccccagagaggagccaggaattgagtgacctcattcttgtcactggggcaccatggtagtatgaaccccagttttgacccaaggatccccctcccatgactgggcacttttccagcaagtttgagggtctgggaagggatgaattttgacagggaa

SEQ ID NO: 10026 - DNA, 2876 bp, artificial
  synthetic oligonucleotide
aagtgcttgaaaagaaccgaaagtgaggaaatattccaactagaatggatccctttgtgccaacagcctcctttagagttcaggaacacagaggaaatcgaggagggctgacttttcaccttagaactcacaaggcccaaatgtgccaatgtttaactgtctctccgaggtgcttctgacacccggaaattcaccatgtatttggcatcaccaggagctcctcaactccactgcttcctcctgcttctctcttccctggccttaacttcaccacccagacccactgtccagcttcccagtctctctgggtccccactgaggctgccctttttggggaaggaagagtggccttttttcttggccctcaaaactcctctgaaggggtctggagcccgctgggagaccaagagcttctcttgaatctcggctgctgcatgtttagtattcacagcatgtctctaaaaaacgtcctgagatcattcatcaggcactgtgctgtgtgcctagctgctctccttccgggtgtgtgtgtgtggccaggaccctccctccatctgctggtgaacacacatgcacacacaccttaacctttttcccttttcaccaaaccaatcgcattttctaagcagacctttgccagctggcagatcgctcccttactgaggtgggctcctggcgttgggcctgggctcgaagccgctcacactccagtgctggggagaggcgctgagagcaggagcccgagccgaaactcaaggtgcgtgtggatgtttgcgatggtgaccaggaggggagctgcagggagggcatccccagcagaaggcgagcaaacaaggggcgagaagcaaggtcaggggccagggaacggagtctccgaagcaagcgttcctgctgccccttctccgcagttcactccccgcccccctttcccgggttcactttggaaattggcttgccctctcggcagccagcagttcccggcagagtccggccgtaacggtcagattcaagaagtgaggcagcgccaggctgggtggctgggttgctgggttgttcttgggagattctttccccaattgtcaattttttgcttatttttagtagtgacccgagccaggaactgcgcctttaagccgctttcccattcggggaaatcgacgccagcactcgagggtcgggaggcgccggagaggcccctcattctgcactcccctctttcctccccctccccctccccccgccccttctcccctcccctcctcggccgtccggccgcctcgccgccatccgtcacctcgcagcctgccgcactcctggagcgagagagcgacgagcgagccacggcgatggtgccgcccgcggcgcagccatgaagcccgcccgaggagcccgcgcgcgctcctgccatcctgcccgcagcccgccgcctgcgcgccagctccccgcgtcccgggccagctgctgccgccctgccaacctctgcccgccccgccgcccggcgccactgagccccaagcccatgccgggctcgggggcacgggtgccctagtcccgctgccgccgccgccgccgccgccgctgcgccgccgctgccgcgccgctgaggaggcggaggaggaggaggaggaggaggaagaggaggaggaagaggagggggaggaaggtaagaggcgcgctgccttcaggggggcgcgcccgctgtctcagcccaaccgggggtgggtcgcggcgggagcgttccgccccgggccggctggggggcgactggcgcttgggcgcccccgggagccgggggcagggcggggggcgccgaacgtctggccgcccggagtttgggcgggcggggtaacggcccgttgcgtgcccactgccccggcgagtctctggcttggcgggctcgtttggcctccgcgggtgcggggtgaggagtcgagcgcaggggagtgcagcgcgttcattatggagcctttgtgtgcgcgcctgggctgtgggcacagttgggagagctggcgagacgcggggcctggctgctaggaggtggccacttagccggggtgcccggcgaagcccgagcccaggggctgccagaaacagctgtctgaagcatgtgcgtggttcccggggccatgttcacaagcggacacggaggcgcacacacacgcacacacagccgcacaacatacccggcgctcagccacacagtcagccccatgcaaagaccacacacacacacacacacacacacacacacacacacacagagagagagagagagagcgcgagctacacttgccccctcccaccaagatgctaataaagctcaaacacatatacagatacatgcacctccccctagcgctgctaaaacatgcacacacaaacacactcctctactccccagcctagtgctttggaggttggagagtgtgtgtgtgtatgtgagtgtgtgtgtgttttctcagagtggtcttgagaaactacatgacaactgcacattactgcagatccagtacctgctgcttccccccaatacacacccagcaaccccccgtcacacgcagctactgtagacacctccaccagagcccttaagaaccccattctggcaaaaagcgtgcccaactctggtagtcataccctccacgctcgagctgttgggtttcctgcacacacacaccacagccccatacacacacactgaaaccactgcaggggcaaatgtttgacaccttcccccagaagcaggtggcacctccacccttgcagctgcaactaaagagccccagatgacagcaaacgccgaattctgctagacctgcccctccccttggcatcttggtccaggtgcaaaaccctggagtccaccgggtggtctt

SEQ ID NO: 10027 - DNA, 2790 bp, artificial
  synthetic oligonucleotide
tatgtgtagaaaacgtttttgaggaattttgttgcccaagggaccaggaaaatggggcagacactgcaagggaattgtggagtagagggaggtgtattttgtttgttttcttaaggatggattatttccatcagcatgctagcatgattctggagcggtggagagattggtaatttaggaaagagaatgaatgcccaaaggagtaaaatccttgagaagataagaggggatggtaccagaacataagtaaggagattcgccatgatagaagaaaagaaacatcctccatttttttaaattatactttaagttttagggtacatgtgcacaacgtgcaggttagttacatatgtatacatgtgccatgttggtgtgctgcacccattaactcatcatttaacgttaggtatatctcctaatgctatccctcccccctccccccaccccacaacaggccctggtgtgtgatgttccccttcctgtgtccatgtgttctcattgttcaattcccacctatgagtgagaacatgtggtgtttggttttttgtccttgcgatagtttgctgacaatgatggtttccagcttcatccatgtccctacaaaggacatgaactcttcattttttatggctgcatagtattccatggtgtatatgtgccacattttcttaatccagtctatcattattggacatttgggttggttccaagtctttgctattgtgaatagtgccgcaataaacatacgtgtgcatgtgtctttatagcagcatgttttataatcctttgggtatatacccagtaatgggatggatgggtcaaatggtatttctagttctagatccctgaggaatcgccacactgacttccacaatggttgaaagagtttacagtcccaccaacagtgtaaaagtgttcctatttctccacatcccctccagcacctgttgtttcctgactttttaatgatcgccattcgaactggtgtgagatggtatctcactgtggttttgatttgcatttctctgatggccagtgatgatgagcattttttcatgtgttttttggctgcataaatgtcttcttttgagaagcgtctgttcatatccttcgcccacttgttgatggggttgtttttttttttcttgtaaatttgtttgagttctttgtagattctggatattagccctttgtcagatgagtagattgcaaaaattttctcccattctgtaggttacctgttcactctgatggtagtttcttttgctgtgcagaagctctttagcttaattagatcccatttgtcaattttggcttttgttgccattgcttttggtgttttagacatgaagtttttgtctatgcctatgtcctgaatggtattgcctaggttttcttctagggtttttatggttttaggtccaacatttaagtctttaatccatcttgaattaatttttgtataaggtgtaaggaagggatccagtttcagctttctacctatggctagccagttttcccagcaccatttattaaatagggaatcctttccccatttcttgtttttatcagatagttgtagatatgcggcattatttctgagggctctgttctgttccattgatctatatctctgttttggtaccagtacctccattttaatagggaaaaaataaaacatgggtacagatgtagacagggtagtgtatagatttggtggcggtaagatgaaggagctctcatctgatagcttctgtttttttcagtaatctatgggatgaggtcgtcagctgagatttcttggggaaaatgggaaagtgaggaagatggaggagagagggcgagtgatgaaatagtcattttagagacagagaaagtgttgaccatggccgggcgtggtggctcacgcctgtaatcccggcactttgggaggccaaggagggcggatcacctgaggtcaggagtttgagagcagcctggccaacatggcaaaaccttgtctctactaaaaagtacaaaaaatggccaggtgtggtggcaggtgcctgtaatcccagctacacaggaggcttaggcaggagaattgcttgaacctgggaggtggaggttgcagtgagccgagatggtgccattgcactccagcctgggcatcaacagcgaaactctgggaaaaaaaaaaaaagaaagaaagaaaagaaaagaaaagaaggaaaggaaggaaagaaagaaggaaggaaggaagggagggagggagggagggagggagggagggagataaatggccagacagaattgagagcatatacccatggattttaaagtgaaatccagctacccagttgtgtgatttttctccagcacccttcagctactccaatgcaggcatggagaattgagttcatcgagggatgagatatagcagggggagaggaagtaaggaagttgaaggtgtttggaagggaatgatcataatgatagaccaggaactctaagctggacatgaagagaagtgaaaataaaaaggaacttgaaggagagtaagaatggtaataagtaggagaaagtgctggcagatgggcatctatgaaaaggtgacatttaagctgagacctaaaggatgaagagccagctctgtgaaaaatgagggaagagatttctagtaaaagggaatatcaagtgggaagtgaataggtgatcatgacgcgttcagatgcttcctgcagtgggagcccttgtggaggtaaactggaagaatggatggtgtcgtagagagtgggatattgggcattg

SEQ ID NO: 10028 - DNA, 1849 bp, artificial
  synthetic oligonucleotide
ggcggagaacggtcctccgccacttctccggctggcgggcgggggccccgagcggctggatcctgtccctccacccctcgccccaccccgcccgcacccttgtgccctggcatccacgctgccgctcgcaccctcgcccgcgctcctgggagccggcccggctctcactctctcggcgagccggacgcttcggttcaggctctttcagcgctcatggcgcatcctccgccagaaatacgcacgcagcccacccgggctgccgtgccccctcagtggcccggtctcgcggggctcgagctcggcgtgagggcaaatgtctctagtctcacctcgaatgggtccccctacagaagagacgacgccctcgagagccccaagtgttgtagccttaaactgccgccctccaaagcccccctttttctggggggggggcgtgcaaggagagcggttgcctctgcagagagtcagagagtgccaggcacacattaggagtacccaataaatgccgtaagcaaaactcagagaagcacgctcaaactctcctcagtttctgtctctttctgcttacttaacgatatcgtcacctcctttccccagctcgctgtgtcctctcttccctgaacccctcagaggcagtctctgtcccggtttccctctgccccttcgccgtctctcctcagtcctccccttccttctctctgctcttctgcttccactcattccactatttcccttattttttctcttttctttacccatttcctctactttctcccccatttccattcttttacctttctttccttatttcttttctccttttctctatttcctcatttcccctttctcccctttcctcttttctctcatttttctctcccctacccccgccatttcccttattttcccctcatttcttacttcagcaccccctctttttcctcacttcacttaccttctcctatttctccaaatttgttgtccttctccttttctgaaccttacctgccaccttagttgatctccgtctgtcgttaccctttcaatagatgtagcgattgcatgttcacaggcctgaggggcgtgccccagctctgtaagatggagggatgttctgggtgggcaagtggtgggtttccagggtttctcaggactcagagacttggaatactttaaatgtgtaggattaaataacgattagtgtctgaaaaaactaaacttttcatgacgttcagttttcacgtaaaactgacttacatttcagtcagtactccccacccccgcatcggctccttcattcacaagtctggcctttgaaatagagcagcatatactgccatctagtgtccaagacgttgaacgttctctgcctgcgtcacagaagctcggagaggcaccagaggtacctcctggtggaatccacagtgcgttggttccaagagtagcagggaagaagtgtaggaggcggagctgctacactaagagagttctgtggccaagctaataggcaggaacacgctcctacactaagagagctccagctaataggcaggaacaccaattagggccagagccgcccttttttctagtggagcttcacttggcctgagtccctgcggattggacttccatagatttgaaacttcctccgggtaccacaagcatcaggcctgtgattaagagcaaagagcggccaactattgtaactcttattcccaaggccctgtgggtcctatatgtgccctgcaacttggggaaaatggaggtggggttgtggtctctatgctgtagcagccggaaagccaaaaacaagccgtacttctcgctcttgacaggatcccaaggtcag

SEQ ID NO: 10029 - DNA, 856 bp, artificial
  synthetic oligonucleotide
tatccctcctctcatctgtgtcttcaacaactccttctctacttactggctgcttcccatcaaccttcaggcatgatcaactttcactctaaaaaaagaaacaaacaaattttccttcgcctctatccccaactggcatttgccctatttctcttcttttattgttatggaatcttttctaaagtgtagacactctccatttcctcacctcctgttaaaaactcagctcccactatggcttttctgttcccagaacaccactgttatttctcttttaagtaaaccaatgacatcctaattgccaaatctaatgaacaatgttaagtctttattttactggacctctctctgatgtatttaacataattgattgctctcaccctacttctgtcctcatgactctcatgacctactccttggctttggtgatgttgcacatcttctgactgtcctcattcctctctgattactccttcttatgctgttttgtggacttttcgtctgccaccccttaaatgccagtctttcccaggttttttcattcctcacctttcccctagatcatctcatccatacccatggttttatctaccatcctattgagccccaaatctgtgtctgtggtcccagacacagacctctcttgagagctccaaacccatatactagttaatacttgacacgtgtaatatggcacatcctacaggtacctcaagaccaaactcagtatgttccaaattcatcttttttattccaatctgcccttcctcctctgtctgcccaactgacaccattttggtgactcagacctctatctacacagttgacctctatctacacagtgctgaaactcggt

SEQ ID NO: 10030 - DNA, 608 bp, artificial
  synthetic oligonucleotide
aatatattgattccatgttatagacttgaattgcaaattaagaaagagtatgtccaaactgtacttgtgctttaacattgattatatatgtgatttatctgatgcttagtccttaatcagaattgttagtgctcattctctgtgcaaatttgatccatttaactgttttatgccatattttccaagaacatgctgttattaaaagtgctctttggtaatagatcaggcatataagatctaagtctcaaccaaagacagcacaacttccctttcaggaagacttgacaaattggattttatgaccatgttttggggattggagctgtctatttttagtgtgccttgacatgatccttatggtcaggagctgaagtgttcttgtatctgaacacaaatatgttaaatattcacaggtttatacttctgtttccctccttttgacttccctctttttttcaactcaacttaggttttcagtggtggtgtcactgctgccaagctggaccgaaaacggccatcggcatgctgcccaaccagcaccatgtccaaagacctgaaaattctatgtaaagaccctgctttggagctgagctgctaccgggaccatc

SEQ ID NO: 10031 - DNA, 2325 bp, artificial
  synthetic oligonucleotide
ttagatgaatgatattaaggaattattttattcactgtgattatgcaaaaagatatacttttgtttctgagatacaaactgaagcattaggggtgaaataacataacgttttggatttgctttaaaatgcctcagcagacagtaaccaaagcagcatggtactggtaccaaagcagatatacagaccaatggaacagaacagaggcctcagaaataacaccacacatctacaatcatctgatctttgacaaacctgacaaaaacaagaaatggggaaaggattccctatttaacaaatggtgctgggaaactggctagccatatgtagaaagctgaaactggatcccttccttacaccttatacaaaaattaattcaagatggattaaagacttaaatgtcagacctaaaatcataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaattaccatcagggtgaacaggcaacctacagaatgtgagaaaatttttgcaatctactcatctgacaaagggctagtatccagaatctacagtgaactcaaatttacaagaaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaccaacaggtgctggagaggttgtggagaaataggaacacttttacactgttggtgggactgtaaactagttcaaccattgtggaagacagcgtggcaattcttcaaggatctggaactagaaatacaatttgtcctagcaatcccattacccagcaatcccaaagtattataaatcattctactataaagacgcatgcacacatatgtttactgtggcactattcacaataataaagacttagaaccaacccaaatgtccatcaatgatagactggataaagaaaacgtggcacatatacaccgtggaatactatgcagccataaaaaagtatgagttcctgtcgtttgcagggacatggatgaagctggaaaccatcattctcagcaagctatcacaagaacagaaaaccaaacactgcatgttctcactcataagtgggaattgaacaatgagaacacatggaaacagggaggggaacattacacactggggcctgtcggggagtggggggctagggaagggttagcatgaggagaaatgcctaatgtaggtgacgggttgatgggtacagcaaaccaccatggcacgtgtatacctatgtaacaaaactgcatgttctgcacatgtaccccagaacttaaagtataatttaaaaaaatgcctcagcagaaaaaggagggaatagatcaaacaagtatagaaaaatgttggtggcttttgaagctgggggatggacacacggggcttcatcatattctctagttttaaatatgctcagtttcacaataaaaatgtttaaaattgcaatagtaacatattttcactgcaaccagttttttaaaaagccaaaatgcataaagctatcatttttaagttttccttgccctcttttcacacaatctatggcatagcttatttttataccaaatccatttttatcaaagtcctatatccccattctcaggactagcctagttttctcccatgcccaatttatcttccttttcattacattgtttgaagctcctcagtgaggagaatgtgatgatagggaaagatccaggtgtaagagctaagccatattattgtttgaacatagtctatgggaaagtggctgctaaggagatgcattctttattagaaaatatatttggaatctggtgctgaggatgtgagatctgaactcagtaagagatcatagacctgaattgctacaatatattcagaccaaagtagctgaataagttagctcactatccaaataaggacgacttagccttttaggttctagattagattaagaagaatgatctatccacattttacagaatggaagtcatttctgagtaaaaacttaagtctttaaattatttagaaacatttttatctacatacatatacacaagttataagttccaaatctaccgcaaataaccaagaaaatatcctggag

SEQ ID NO: 10032 - DNA, 760 bp, artificial
  synthetic oligonucleotide
gaggccacctcccctaactatatcacagtgaggggcagagctgtgactaactcaagccacctgacccctagaccaggaccctttccaccacatcatgctgctcccacagttgccattatgatctaagtatctatgctctttaatagaaatgggactagaatccagatcttaagtttaataagttataataataataaatgagcccttgtggcttcagatgggtcacttaatctctctgggtctgagatgccttatttgtttaaatgacagaagaattccagttctgccttctgccacatggggagaaagatggtagctatcattggctgagcacttccgaggtcctttactagatttcttagtttcatcttcacaacaccactataaagggatgggaccagatgatttctaagatgcttttccgctttgcttctaataaacaaaacaaacccaagtttgtctatccaaaagagtaggtgtgtctaaaaggagcatgaacatttgaacatttaaggaaaccagatagtctcactgggtaaggtaaattcaaattttaagaagtttataaaatggtaaaaaaaaaaaaatgatggttttggtttcccatcagacatttgtgttctacataatgagtttctctcaggtggattcattaagtgagcatcttgatctcctagcccaagcttaggtgttgaatcctgtcagctccagctgcctcctcctctgtaagataggcatactaatccctgccctgatgaca

SEQ ID NO: 10033 - DNA, 1544 bp, artificial
  synthetic oligonucleotide
tggtacaagctttctttgtctggaatgtcctttccctgatgaatttgcttaactctcactcattttctaaggtcgagtgctgccatcagctttctttccacagcctcctttatgcctcggattgacttagatgtccctcttctattcttccttagcctcctatacagatactcatcacatactgcatcaaaattaactcttccttctctttcttcccattagactcagaattactaagatatgttgctactgctaaggcctagcacagtactggttacatggtaggtactcagtaaaggattgttaaattgacatttggatggacatataaaccagcttttaggctttttttttttctgtacccatccattcaacaaacgttaaaccttaggagaggacttattgcaaggcactatgaccagagctgtaggggatagagagatgaacattacatggactgagactttaaggagttcatttcaatagcagagagataacatgtccacaaataacaataatctaaagtagaaagtgctcagtgtcataaaggaggtataaattaaggactgtggatgtttagaagaaggagcaagtactccttgttgggaaaactgaagaagaatgattcatcaagaaaggagcatttgaggtgggatttaagggcaagtagaacatgaatgagcaaagatagaatctcctccgtatcatgtgttttattttgactgaaaagagtagatattatgaaggagtaatgagtaatgggaaacaactggaaatttacgaagtgggccttattagagagggctttaagtgccacgttgatgagtttatatttgattcctgtcaggtggaacagtcttggaagcccatggaagatgtttagcattttattgtcaacagcagagagatcctgtaacattagtctggcaatggcatatcttagtaaatcattattaactaattaattgctaagcctatagttttgctaagtagtgtggaaaaaccctaaggcctttagctcttttacatttttgcacctgtcttttctcactggaaatctagatgaggtaacagattatatgaccaattagttctgaaaaatgaaaatagaaattgacaggggaaagaaacactaccaagacagaagtgcctcataataatgtatagacatataaagtgttgtttgcttaggaaccgtgtccaaaacattgctttcagctgtctggaaaaatccagacacagtatgtgaattatattgttaatatttattcctctgggagtagtttagatcactttcagttaaacataactataatgttctaacctcagactgtctgctcttattgtcccttataaacagtgggtattgcattgtcagtttgttttatagtgtgttatataaccagagcatctggtttcttgctgccttaggccgggccttcaacactttatgcctggattgttgcaacgactttctcattggtctccttatctcctgtgcttagaatccagctttttttttcataacagcaatgtatagtggg

SEQ ID NO: 10034 - DNA, 1133 bp, artificial
  synthetic oligonucleotide
tttctttctctttttaggctacactatatgttcatttaaacctgatttcttctgcctgtgaggggtagagggtagggtggggaggtgcacagtgtgatttgccctgcctcagtccaccacctcctggggatggcctgacctggataatcatttttagcctggtatttcctgggcatgggccaggggctgaggccagcagcagagaggctaagatggcacaggctccctgtcagatttggtagtgatgaattttcactggggaacaaaatggctgtttctaacttctttagatttgaaacactgcagagactatcatcttaataattaaaatatattgaggagaagggctacttaaatccttgaatgactggaattctgtaagatattttaagaaaggtaatatccctggttaacagtgtttctttttctttttctttttttttctttttttttgagatggaatcttactgtgtcaccaggctggagtgtagtggcgcgatcttggctcactgcaacctcggcctcctgggttcaagcgactctcctgcttcagcctcccgagtagctgggactacaggcatgcaccaccatgcccagctaatttttgtatttttagtagagatggggtttcaccatgttggccaggatggtcttgatctcagctgtgtttctaaaagtacttgtacaaattataatttcaacttccaacaaaatatttatatgatcagaacagactcattttttttttatcagaacagactcatttatatttaggagcatttatttctatgaaaacaacatgccctggccttagaaaacaaaaaataaaataaaacaatttatcctttcaagggatttcttttagagaatctctgcagctacttgtagttgtacaaatggccccctactttctctgtgttcccttcctcacaggggctgaggagcccccatgagttgagaggtgtatgttgaatatcttagctttgaacttgaaatatattttctcatagatatagcaccataaactgtgaaataaactatcaatttaaattttctagttacagattaaaataggttttgtggactagcttggaaatatatttactgtttataatataatttctctcagaaaa

SEQ ID NO: 10035 - DNA, 1714 bp, artificial
  synthetic oligonucleotide
ccagcacatgctctcaacttacctcttggccctgccttccccttcattccgggaaatcctgggtctccaggtggcccaaccttgcctggagtccccatgaagccaggctcacctctcatgcctgacaaagcccaaaggaagcaagtcaggtcccggcatggtaggggtggtaggggtggaggataggcaggggtgaggtagggaagaacatcagccaccggcctctcttcacaggactgcaggaaggagtcctggccgtggagtggggaagggcccagcagccagccgagcagccgtacctttcagtcctagctctccagggaggccagaaaaacctggaattccttggtctcccttaggccctttaggtccaggaattccagggaagccagggtctccggtgtcgccttgattcgaggatggcccagggggacctgggggtccagcggggcctgggcggcctagggataagatcggaagaggggcgaggggcaggtgaacaggtagtagccactgcagaaggcctagggactgacaggactccaaagcccattcccaggacagagaatgttccctcaccatcggtggggtcctagtgcccagactttcccaaaccattttagcaaaatgcacttggctcaagtcccctgtgtccccactcggggagggatgtgaagccaaacacgcccacatatgtccagcaacagggacttggctgcgctgtatacatgacttccccaaatgtcagacaaaaggtggtggctagccctcttttgggcttcctgtctttacctcgttctccatctaggcctggtcgcccggggtcaccaggctgtcctgctatgagtgagggcaaggagatgcctggggcaccggggagaccagcagggccctggagacctgggaaacctgtaaagaataaataaaaggggctggataggctctgtgtgcccagaagatggccaggctctttcagagaaaatggaagctcacacagagaaaatggaagcagttaggtaggagccagaccagagaacgccagcagagggctcttcttccctaatccttccttcccagaaagcagactaactgacaagggctcagagactccccttttccagctggagctgcattttattggaaagttctagctcccttacctcactggtaatggaaatattttaggccaacttcccccacaccagaaagaaaagaaggcatgactgagcacctggacttttaagtttccaaagtgattttaaacctgtctgtgtcaaaaaacacctcttaagttagccagttatgtctgatgctgcacaaaggttacagaacgtaggccacaggccccagccagtcagaacagacaccaggccgatcagaatggaggcagcaagaatgcggtgcctctgtgtcttctagggctatcttctgcaatttctaggcaaactggaaaacaatcttttataggtcattcatgatatgagccaagtgattgcttaattgcctatggaacaaatatctctgtactaaatccctcccccctttttggccaaagagaataaccacttattacaatagatacagaatactcatttgctctaattttaatactgctttacatgttttctgtttgtggaactatttctattgtaatatgttcaaaaccaaaactttcatctgatcacagaagatttatttaatgttcacatatcaa

SEQ ID NO: 10036 - DNA, 1441 bp, artificial
  synthetic oligonucleotide
aaaaagccaactgaatgatctgtttggtattcagcaaaggatacatctccacttagtaaaatacatgcccaagttcctatttaggcttgaggttaagttaagagacagaactaggttttttcctttgtcctttgtcaatgggtatttattacctcaacatttattttctccttttagggggtagcatgtccttgctttgctggattttcatggaaatgttttgttctatacctggttgccatggcaatctttggagaactttgtaacccacttatctcatcctatgttagcaatacatctttccttacctccccaccccccggcatattgatttggtccttaggtgtcaaagtcctatatgccaatctggggcttgtgctttgtccatctatctcattttctcacacatatacccacaccccaacctggtcactgaaggtggtggtgctgctcttccaatgaagtgtcaattaattcatgtagctataaaacatgtctcatgaatggagtgatttctagttaaatatctcagatcagtgccctcatgagtttagattatttcaagggaggttgacaatgagtctgaaatgtgttattttactctttccagccacttgtaaaatcagcctggaagggcattgtatttactagagatcccttagatcaaaatatctgagccctatctggatgaatagaattaaataaaagtggtgacactggaatccaataaataccttatcaataccataaccaagggttatgatgtgggagtgtagccacaaactctgttactatagagtagggtttctcaacctcagcattattgacactttgagccaaatgatttctagatgttggggagggggctgtcttgtgccagtagcacaccaccaattgtgagacctcaaaatatcaatagtaattgccaaatgtcccctgagtggcaaaaatcacctctggttaaaaaccactggtatagaccaagcttgcaagcccctttgggttttggttagtgcttccatgatcccatataagtcttccaaacattcctcaatattgtctgatgtgggaccatgtcaaatagcccaagtgtgtattttgccatgaaatttactacagccttttaacaatcttgccaatttcacaagctgcattaaaaaaaaggcaaccctaagcagtgtagcatgtgcacaccccactgcaactggtattcttctttagacttttactgttgtggtgctgccagtattgactcctacattggacaagggtgtgtagtggctgccccacaaaatcttgaggtttccagagaggcagaaaaagggcacacgtagagacaagcaaagccatttgaaataaaatgcaaatatctggcagcatacgggtggtccgagaagcccaggatagccatcagggcctggaaatccaacagctccttgag

SEQ ID NO: 10037 - DNA, 861 bp, artificial
  synthetic oligonucleotide
gcaagacatttacaggaaagaatccagatataaattcaaatatttgagtggatatgacttatatttccattttatatagaaattaacttcatctggcctgttacccagatggatactaaccatgggtgggggatgaatgttcctatgttactaatagtgtctccagcatggattaagtgtctaaactaagctaaactaaacctaaattaagctagtacacatcatagacatatagagtgaatacctgttcctaactactgaatctcaacgtagggttttatttacctggttttgagccctccaagcaaacaaaagttgccctacttgtttttaatccatactaactaaaacttcaagtactatgttccctcctcaatctttcccatcccataagacttcattaaccaaacaaatctgttttcagatgacttttagtatgtaaaaatgaagagtggatcttaccactcatcatccataaatgaaacaaaattaccaaaacagttgaaagctgaaataatttcagtttatctaaataaaacacatgtagtcatcttctggaactgacagaagggcatgagttatagcatcatctggaattgtggacaaggcagatacatgttcaagcctaaattaataaaagctgagtaatagctaacaacccaagcataggagatcagcattaatgagattaactcttagactactgtacattttcttaacctgattacaaaaccaggtgtgagctttttatccctgccccttatgcaaattacgcgcatttaatggagtgtggtacagtatggctgatggtgacatttgataaatacaggtggggctaatgcaaattttgtgggttggtga

SEQ ID NO: 10038 - DNA, 203 bp, artificial
  synthetic oligonucleotide
taccaagccttagttttctcgtatctacccactgggtagttgtgaagatgaaatgatttaattgaatatgtataaaacacttaccacagtgcctggcacataataagtacttaataaatgaaaatattatcatcactctagtctgattaatggttacattaacccctacattaatctctaagatccaggcacaaagaacatct

SEQ ID NO: 10039 - DNA, 1587 bp, artificial
  synthetic oligonucleotide
atcaactctatttaaatatttccaattaagtgtttatattaattctaagaaacactgcactaaatttatttaattccctgccctaaatctttctgaaacacaactacaatgagagtcaataccttttacattagctcaatataggaggcattaattataggattcaatgcagctaaacagagatatagctgtattataataacataataccatagaataattaccaatacctgctgaatgctcccagatcttatacgtatataacacacataaagtattcacgcacatatacttattttcttacttgtttataagcatatactttatttattcccaatattttcacatcttctgcttgtatgtagaaactctctgttctgtgagcagctggaaggtaaagaagaccagcagcccagggagcaccgaccaaaatttgtttctaatgagtaacaataaaaagcacggcccctctgagatccatccgctaaaaaaatagtcccagtttagatctatttgtaattggctttggtacgcacaccaatgagattggaactgagcctagaaaagtagtatcaacggaaggtgcaaatgaacgaatagaaaagcttcccggttggactcatggtgctcagtcaactagtctggaagtttccctcccccaaataactgagcgtcactccctcgcaggttgccggtgcagtctaaaactgtggcggagtgatactcaaattcccttgtgctggtgaggaggggggccttgcacggggaagagagggaggaaagtagatctgtaggaattgagtgaagaaaaagtttgcaagtctggacagaagggaaaagttctcctgagagaccggctttggggaggggaggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggtaagtccttcctcccctcccccgcgcccatcaccgctctttcacgctgaaattaccttttttttggggggggggtccctttatcttccttttggcgttgactagggaattcaaatttgctttctcatgtttaggaagaaacgttatttgcaacaccggtaactcaagccttctgaagtccaacggagaggtttaagtgcttaaaaatagggctgcttgcttccctgcagctagctcctccgggggcaagagcaaagtcagaagtgggggacgctaattaaaggctcactaggctgtggtgggtatttaaaacttttcctcccctccctccaccgtcgggtgtttccctgcctggcgactaaccttttcactacttgtacccagcccactctttgaattttgtctgtagtttaatattttggctcttcgaaaat

SEQ ID NO: 10040 - DNA, 6713 bp, artificial
  synthetic oligonucleotide
tcacagcaaactagcacaacaacgactgctctttaaaaagtaactttcagaggagaaaattatcctccctaaacataaatagttgattattactgcttaatagtctgtgctcttattaaattcctacacttaaatatgggcatttgcagaaaagcagcttttaattgttgatttgaaaattagttggtggaacccaatttacgatatcctgctttacattatcattaaatgatggggaaggatgtttaaaagtatccttatgctttttatgtctgcgttttaactactcctaaaaaagtagaaccagtgtttaaatgataatcagttctgtccagataaagaaattgattagataaaaacaaatttttgcaaagatcaaaaaggcatttgtgaataattaaaactgaattctatactccatgtcgaatagcaccagttaatgaaatagtatccctaacactgtagactgtagcgcatcgaatcattagacaatgaccattcactttagggaaattaattctaaaattaccgacctcttttgggagagtcgaactgattatcacgtctggcaaaatccattctcacgtgagtgtcgtcgtcgttgtcagaatcttctctctccgggggtcttggcacccggcgactgcgaggtggtggttccggagcggcagctgcagcggcagccccgccagcctggttatcacctctggcaaggtttgcagatgggttgtgggctccagggttcgagccaccggcaacgtcttgggctccccttactgcttcggcatcagcagcattagcaacaggttgaaaccagcgggcagaggcggagtcaaatccagcagctgcggctgctgcgccgatgcccggggctgcggcgagcgcggaggccgcagctacaacttggctgagggctaaagtcggctctgcagccgaagcgacagccggggctgaggatggggaaaggtctctctcgaggctgtctgttggaaaagcagagacagcggctctggctgctgcaaagaaactttgagaacggctttgtgggcgtcttctctcctgctcttcttcctgcagcagcctagctacaggtggtggttcagaacatcggctgggggagagagaaatatccatacagcactcagaaaatgggtcgaccacatagattcgacctgtttcagcatcatagcgaatggcactgtcagcaagagccatggctggtgtcattgctgagttgaaaattacttcaatgtagtcaccctcttcctcaatagcattgctacctgtagcactgaggggaaggggaggaagtggccacctagcactgtccagagataaggggttggcacgtggtatagctcttaaaagatctgagaggtcgtttgctggatttggaaatggcactccaaactcaacattcacataattagaaaaggctgactgtctgggttcagcaattatgccccacgaatctggtagtccttgagtagagggagctggtgtattgctctctcttttagtgaagtccatgttgacgtagtcactagagctgtcagcttctctctgctcatgtgtgggcttttgtggttttggcttgattttatatccttttgtaataaaagaaagtcggttaggtctcttagctttattctttgggggctcatgatctgaaggctttgaaggtgatcccccatctccaggctttgagaatgatccctcacctgaaggctttgaagctgcatctttggggtcccagttataggagacttctttgtctaggcccctccccaggaactttccaggtaacattggcacatactcactgttgtcattctgtcccaaaggtgagctccgaaaagggtttggtagagagaagtaggagctccaacttttggaggaagagccaccctgaggatttctggggttttttggaattgcaccggctccaggagccataaacatgtagtcactctcactgtcattgtcctttgagtcatcctctttattagtatcaggtgcttttggaggactcggagcaggtggtgggctcactctgggaaacatcatcatgtaccctcttgaatcttcaaaaggggatcgagagtggcgcttttttgaagcagagacattttgaggagccattggcatataatcactggagcttacaagaggggtggccacccctggcctcattggcacgtatgggtcatcctcatcttcatcaaaagctctggctctgtggggacctcgagctgcaccttctgggatctctgcatctttcacttctttggcttctttgcattctttcgtggctcctctgtcaacacaaaaataaagtctgaatcttcccccagacttcccttttccaccagttcctccagctggtgggggtggaggaggaggtggtggaggtggtggcatttgctgttgcttgctttgagttaatttgccaaaataggatcttttcttcagagattttccacgttcaccatcaccatcggatcctttcccacttcctgagcctttgccccccccagagttcttgccaccacctgagccatggccatctccaggtccctggccaccacctgagccatgcccacctccaggtctctggccaccacctgaaccgtgcccacctgcggtgccctggccatctctagagcactggtttcctcctgagccctggccatttgagccctgaccacctcgggatccctgtccctcgcctgaacactggtttcctcccgagctatggctactggagccttggccatttgagccctggccacctcctgagccccggccatttcctgagccccaattgttcataggcatgtagtcacctccgcttccttcctgatcttctttgccctggggattgccttcctccccaaagttgccagagccagaaccagacacttcagaagacaggcgagctccattgttcggggcttctgcagggtgccggggacgtgctgggctgggtgctaagcggcgaaaaaagctggccggcactgaaaccgctctccttgacctgcgccctctgggcaggtgcagtcttcctcgcctggagtgggccacaggctcgctgggtgttacgaagcgcctggtgaaaagcatctcgtcttccccgtcgccgatggccctgaggtggcaaaactgctcaaagcgggaccttctgagccagcctcccggctcgagcggcaccaagcccaggtgcctcctagcggacagcagggttaacaggtgggcgccgatgctgatgctgtagctgcggcagcgggctctgtattcgtctgcacacaaggctctcatcttctccaaaaacagctcatgcatgttttgggcaaccacacagtcatcgacctgcatccagagctctcccggaccgatgacagtggacctgcctacttccaagaagaaatactgctccgagtgtccacagcgacggatgctcaggagctggacgaccacgctggccacttcggtgttcagcctcacaaacacgacctcctcgtcggttagacacagccggaacacgccgctcagctcttttctgtgccccagccccctgggtttgactattacctgccacacatctttatagaagggtggctccgccgccgctgccgccgccagcgcggccggctctccgtccggctgcgcgccgagcgtgccgcagcggcggcgcttgctctcgaggatgaggcggctgagcagcaagtaccagctttcctgctccgactcgttctcggccaccatcgcgaagtattcgtcttgggtgaaaagagcaatgaggtgtcggtaccttgcatctgctcgctggctcacggaaaagcactggtatagggtgatcacgcgccgcggtggaatgagcggggggatcgcggcgccagaggcggccgccgctgctgcagccgccgcggcgcggacactgtgccggaacttcctggcattttcgtagtattccagccgagctggggcgtcagcagtctcgagtttgagcacgaagtagcgcctgtgcccatgcttctgtttccgcaggtagccgcgtttgcagacttcctccccgacgggcaggtcctcctcttcggactcggagtctgaccgggagccagtggccgtggagagccacatggctcccggacaagacgacccggtcccaatgagtgcggtcggggttcccgaggaaagaagcggggtggtcaccactgctgctagagctgccgctgccgccgctgctgcacctcttagtcttcttgtcgcttggtcgcgagtgaaggagcaactcgccatggtgatgcacgatggttttaaggtgagcgaggaggagggggaattcaggaaagggagggttgggggaagaggctgtctaccctcgtctgcccgccccagccccctcctgccttggcccgcgcccccgcccactccactctgagcgcacgacagcgggcaaaacaacacgtgaccacagcctcacgcggcggccgctgcggatcctgctaccggcgcaatggaggggcgcgagcggccaccagtagaggtgagcaagggaggagacggcgggctcgggaggcggagccacctccggctgtgccaaatcctcccggtcaatctccaggcctgtgggccaagggaggaccgagaggaggaggcgggctctctggccaagctgattctaacagggagtccaggaaggcatgagggggcgggagaaggcctggaggggcggaggagaaagcggccggctatcagggtcgggagagggcgccacagtcggggccccattggtgggaggtggtgggagggggcgtagcgcaagcagtgcctgcctgcggcgccagggtgcagagcgggcacagtcgcgggacagtttgtttgtttatttgggaagcgggagccaggtgaaactgttgcaaggctctgattggttgggataggagccaatgggagggtccggcaagaaggcagccccgaaatcattagtttggcgggagggaggggtgagaggggagaggggagagggggcgtggctggggtcccaaagtggcttcgctgtcggcttgtggcgctctcaggcggtaaacaaccttacgcaaatagctgttaatggtggtggtaaactcgtgcaaatcccagagccgtggtgacccgggatggagtcgggtgccctggtactccctgtcaatcacataaattctctgttcctgtcacagtctggttcattctttccagccgcacaaggcggcggatcgagcttcttgggagaaagtgtcggcaccccctgaaaacgggttgacgaccagggcgctcagaactgcttcccaccgctctgcaggcactcccgagcccgctgcacccctgacagaagcccgcgactctgaggcacacgaataacagcgatgcattcaaaatgaacatgatctttattaatcagaatgcacttctagcccacgaaacacaggttccctaaatacagtgtttctgcctatttgattaacgatgactatgaaagcacaaatttgggggcctgcaatgtatacagccatattggaaaaaattggactcgattcttactgaaataaccagtgttgggctgtgaaggtatttttctgtgggaaatgctttggaaggtgcctttaaaagaatctcaaaatattgctttcctttccttgagcgagaccgaaaaactttagaaaaagaaaagctcatacctagaacaaaggaccacgctgaatgcatattctagagcacatttcacatccctcgcgtcaacaagaagaagaagaggagctttgatgcatttcagtctacaagttgacatcacaaaagtaagaactactgcctccctcatttctggaaaaactgccggagtgtaagtgcaacctcctcaagtctctctctctctctccctctccttctccctttccctctccctctccctctctcccccaccaccccagttattacttgactaggattttagactcttaatggtggagatgggtcgtgaattatcaaaggagtgaccaggtttgcaaagaggaatggagggagaggaggagagaaatacagcatttctctctgaaagaatggaatgtcagttcacccttgctctagggttgatatggcaaagggtactatttataaaatccaacagtaaactaggcaatatgtatatcataaaaataaaccatatttctgccctcttaagaatttgctctgttagaaacagaacacacgtatttgaataaatggctcctttttgatgctataatttaagagaaaaagaaattggtttgggttgtcccccagatattacaaatattcaataacattccctctgctgccaatggtttataagtgcaatatattcacaggtgctggaagcagccgtggtttcggaagggagctagaggcagaacgagtgtggatgctgagagatccctgactgtgactgctacatatttcagctgcgtagtcacatatatacaagattccctgcacttacaaccaaaatgataacaaatgctctcatttgggattttgtttgatagtcattaggatattttataagtctttccaagcacaaggtttttttctttttttttttaaagagaaatgtgacaaataaggcaacatatttgaaagtgctttgagtaataacatgacattgaaaatatcaaaatgaatattaaatgaaatgggaa

SEQ ID NO: 10041 - DNA, 279 bp, artificial
  synthetic oligonucleotide
agggtaagtcagcaagctggagacctaggatagccaatagtgaggatccagtctgaagaccaaggaagagctgatatttcactttgagtccaaaggtggaaaaacaaacaaacaaacaatgtctcagttcaaaaacagtcagacaggagcaattttctcttacttgcaaaagggtcaactttttgttctattcagaatttcagctgatttgatgaggaccaccctcattagggagagcaatctgttttactcagtctatcaatttgagtgttaatacca

SEQ ID NO: 10042 - DNA, 3507 bp, artificial
  synthetic oligonucleotide
aagaaattgtaaaatgttcaatgactgccttagagattggaaagaatacagctgctgtcaggcctggaatactcaccaagggaggctttccaaaaagggaagagttcctaggttaatgacaggcagttagctcagtagtctagggaagaagccaagctgggtggaggcagttagtcaggatgggtaatatggattctccgtttctactgacaacagtgccagagaaagcgcccttaaactgcagcatgcagatttagagaaactttaagaaacagtctgagctgctggcatgcaatggcctaggcttaaaggaagacatggacagcagctccagagtggatctttgacagcttgagggctagatgtatatacctggtgtggaatgcaaagaccattctccaatataacatttggtacctccgatcaagaaggggccttggatgggtcaggccatggtgcccagtcagaaaagacttctttttatcaatccttgggatagaaaaaagaaaaatccctttctgcttgaggagactaaaggaataataaactaaatgatcggcaaaattgctttcatctcaaggagttgctgaatatcagcacctgctcaaatagggtgcacttaatacatgaacctgacctaagaaactgaaaatgctctctcccagcattgctttgtccttctacataggggagcagcttcagcaagagctaaagatgaggtttcttcttggacacacagagtatcaggcatcttcaggttgttctgatcattactccacaaaaatctctgtactggcttcccagcctatgttccctctatccattttctcattcatttattccctcatccctgaccttccaaatcattctctctgccatctctctctttagagtgcagtagtttctgcttatcctcagtttccctgtctatggtttcagttatgtgcaatcaacctcagtctgaaaatattaaatggaaaattccaaaaaatatacaattcataaatttttaaatgcatgcccttctgagtagagtgatgaaatcttgcatcatctgagatgtgcaagatctgtcccacctgagatgtgaattatccctttgtccagcatatccgtgctgtagatgttacctgcgcattagtcacttagtagccatctcaattatcacacccaagaaacagagtatacacaggcataccttgttttattgcctttcgctttattgtgctttgcaaatagtatgtttttcaaaaatttaaggtttgcagcaaccctgtgtcgaacaagtctatcagtgccatttttccaacagcatgtgctcacttcgtgtctctgtgtcagccttttttagcaacaaagtattttttaattaaggtatctacattgttgttttagacacaatgctattgtacacttaatagactacagtatagtgtaaacataacttttatatgcactgggaaaccaaaaaaatatgtgtgacttgctttattgcagtattcactttattgagatggtctggaaccaaagctgcaatatctttgagatatccctgtatagggcttggtactgtctgtggttttagggattcttggaacatatcctctgagtataagggggactaccatgggtatatatttctaactatatgtgacagttatgtgcattaatcagaataatgttatgctatgttacaataacaaacagactgtaatctcagtgacgaggcacaactaaagtttctttcatatacacataaaatctgatgagtgtcatcaggggtctctcctccaattttggcaattccaggctccaggctctttccattttatgatggcaccatttcaacatgaggccccaagttctctgtagtagggggagagagggctaaagactcctgtgagatattttaagggccaggctaggaagtagcttgtgtcatttattccaaatcccattggcaagaatgtagtcacatggcacccatataattgcaaggaagggtgggaaatgtaacttttctatgcaagcagaaagaggaagaaaacaagacttgatgaacacataacattgtctcttccagtgtgtgtctgtggtgccgtgcctccttttccatcttggtgtcagtcccttgaggaagctcgttacctcccaacccatacacagcaaagtatgggtgtaacaaggtgttagtgaacatgaacatgaacattatccctgagctaaactaattaataggtagagcatggcaccaccaaggccacagtagcatgtgaaactaatctgtgcctcactctttaacagtaaaatgaagatgtaatgcttatcttgcactgttgtcagcattagaaataccacatgccagacacagatagaaaagggacaccacagtaaaaggcttcactttgccccatgaagattcatggtttacagggtggttccagaagcattcaggctggcttcctcaagatctgaagatggctgcctgactgtcactatcagtttgggtgtatatatttcacttttctgaagaaactggcctgttttttcttacatctagctggggagactatccaactctgcccagaagggcagtaagagcttcattatatagctatagaactgttttaaagaactgcaatagctaccagttattgaatgtttgctatgtgctaactacattatattattctctaatctgcatcaaaactctccaaactttacaaatggaaaaactgaagctcagaaaagtcaagaaaattgctcaagatggcacagctaataagcaacagtgcagggcatggattcagatctgtatggcctctagtgcccctatgggggtatagagtgaggggaaaggagtgcttggaagagtggccacttctgtttcaactacatttttcccttcctctacttcagctccttcctctgtttgaacttcccttctgtccactcctccttgtcttaagagtgcagctccaacaatatctgacaaaggacggcaattcagtttcgaagccacctccacaccatagaaacatccactcaaagagggtttctgggcccaaagcaatcttgtctgtcttaaatggacacattggtctattagaaaaatagaatatagctggagaccatgacaattagtgaagtgcccttgagttctcagcccacaacccccagcatgaagcactctttcagtgatatcatgcacagctgaaagggaaacaggcttgaactgaccttgctgagcttgtaatgtgggatgagaagaggaagaacaaggtaaggaggactctgccaccaatccagcagggaccagataagaatcatgctggtaaacaaggaatgggttgccaatgaagcctccgtcagccccaaatgaactaaagaaattaactaagaccagcttgcgacaggggtggggtggagtggagaggatgtcagagctacatgggccttcagataagcctagtccaattctgtcattacacaagtgtggaaaccaag

SEQ ID NO: 10043 - DNA, 706 bp, artificial
  synthetic oligonucleotide
cctagagaggattaaaatacagatgggggcaagaaagaatgccagtcataatttaatctgggaccctcactttatagacaaaaaagtaagaccaaaaaaaaaagatgaaataagtttcctaatatcatatagctagtcaattatttagttacaagattattgtttgtaaaaatctgacatttaaaaaaaatctatagcagacctaggacagcatcccaccttgctgactctcaggagtggctctttttgtgatactatgctgaatggcatacttctttgtgcagataagattaacggcagagggtatcccagaaagcaataatagtagagagtgagcagatcacatgcctatatataatttatgagtctgatgcttaaataggtcacattctctatttcttgatttttgaacttgcacacataagtctggtaggaaagggctcggaactgcacagttgaatgacaagaggaagagttacctgcaatctgtgttaacctttaaaattgaacctctgtatcttcaattgaaccagtagacttatttcacatgaagacatataagtcaacaggttcctcatattctccatacctccaaatgtgcctttcttagaattaaagcaatccagagctagccgttaccttttggtattgtctaggagtgcccctaccctcaactccaacatccttattttataattaggaaaca

SEQ ID NO: 10044 - DNA, 2616 bp, artificial
  synthetic oligonucleotide
acacatcaacataaggattcaaaaaggttgaaagtaaaatgatgagaaaatgttgtatcaggcaaatactaaaataatttagtagatctattttaatatcagaagaaaatatacttaaaggtaatagagaagaactgagttactacattaagcctctaacattttatgtcttttttgcggggaagagtcactttttgttttctctatttgttgtttcatttttactgagttcaagggagggggaagaagtttggggctaaatggtagggagaaagtaagaaagaaacaggtgattagtatgaagaatacttctcaggtagagccaaataagataaggaaacagattttagttcatcttgttaattaaatgtatgtctctgcctgaacctttcattatgatatcctgacaattataaattacatttttctaagaaatttgcagactgggtaagccagagtcttagagggacttcccaaaacctgagagctcaaccaatacgaaagccttattattcgttttgcttctgcaaataattacttgaagaaaaataagtttccagcagggagttgaaagaattgttctcctttgaagataagacttgtgaatatcccatagaggaagcaattggaaagtaatgaggcgaaaatggattatactctcacttctatgccacaggaggaaaacgtttcctttataggaaattaattcacaccttcacttccttcagaatggattcagaatggggatagagacaagctaaaaggagaaggaaattttatttggtcactcaattttaaccacctactttgtgtaagagtttttctcagtgccagtggtttgggtaagtgtttaatatatgaaaaatatatagttatcaccgggaacttaaaatatagtaggaatttaaaatacaaataataaaagacagactataatgtctttttagaatgcattttatggtatgtatctaaggtatacaaaattatgttatgagatacatatataatcaaatggttatcatagtgaatcaaatgatcatatctatcatttcgcatagttacccatttttcccatgtggcaagagcagctataaactacttgtttagaaaaattcctgaacataatactctactattaattacagtcctgttacatattagatgtttagatttgttcatcctacatatctgctactttgtatcctttgacctacatctactcatttcctctccctacctgccccaacacccctgtgaccactattttattctctatctccatatatttgacttttttgtcagatttcacatatgtgacatcatgcaatatttttttgtgtgtctagcttactttatttagtataatgtcctccaattcatccatgttgtggcaaatgacaggatttcttccttttatagggctcaatgatattcaattgtgtgtgtgtatatatatgtacacacacacacacacacacacacaatcacagattctttatccattcatccattgatggacacttgggttgtttccatatcttggatattgtgaataatactgctatgtacccaaaggaaatgaaattatcacctcataaagatatcttcactctcatgttcattgcagcattatttataacaatttattttgaaggatgtgcaaaagtaccatctaggcaggactactggaatggcagagtgcacatctctataaaaccaccactccataaaaacaatggaaacagtgacaaaaatggtcaaaatcatcttttgcagaactctagaagttaggtaaatatctgtgagaatctgaggagtatttattcagaaactgctaaatatttctaaggacaccaggatttgtagaattataacttgatacgctcaactactcccagacctctctcaacaactccacaatagcaaaaattaacccacaaaatgagacaaaatatttgtacatcatatatctgatcagggacttgtaactatatatataacacaaaactcaataataaaaagccaaataacccaattttaaaagtaaacaaaaaaaatctaaatagacatttcttcaaagaagatatacaaatggacaataagttcatgaaaagatgctcaatatcattaggtatcagggaaatgcaaatcaaaaccacaatgcccactaagatggctgtaataaaaaatacagacaataacaagtgttggtaaagatgtcaagaaattggaaccctcatgcattgctggcagaaatgtaaaatgttgtaaccactgtggaaagcaggttgacagttccttaaaacattaaacataaattacaatatgaattagcaattccacccctaggtatctaggatacgtcaatacaaaaacttgtacacgaatgttcctagaaacgttgtttataacagccaaaaagtagaaaccatccaaatgtccatcaatggatggatgaataaataaaatgtgttatactcataccatggaatattattctgcaattaaaaagaatgaaatgttcatacatgctacaacacagatgaatcttgaaaatattctgctaagtgaaagaagccagacacagaggaccacataatgtaggattacatttat

SEQ ID NO: 10045 - DNA, 999 bp, artificial
  synthetic oligonucleotide
gtacccttctagagtggtgggaagagggatggcccctcgactattatggtcttcaagatggttgtggtcctacatgcttagctattctctaagaatacagctatgctttctaagtataaaggctgttctggaagaaagagcgagaaaggaaaagaaaaaagcaagggcttcccctccacctttgttcgcttcattctgtagtgcatacttttatgcccttgggaagtggaagggaggaatgagctaataatttggttgattcaaccttctgacctctgagtcaaaaaattacccaatagtccttttagcaggcgatgagggggtaatgcattcagagtcaggagtctgtgcctctgataatgattcatatgctgagtgaccttcgggtaagccatgcaaactccctccgtttcaatatcagtaataccaactgtcccccctatctcttggggttgttatgagagtgtgatgagatcacagatctgaaagcattttttaaatgtcagacattatcataccaaaaaggaagccgtccaccaagagctggtctgtcttgatataactttgttacacaattgatgtattaattcctgttctatttttctagctagctgcttctaccactacaaagttagtatcaaaatgtctaaataagcagttgtattaatcaatgttccagtttacaaatggaaactctgcaacaaaaaatgtaaaaacctagattactttttatcataatgtgaattcaaaggtcttgacttagcccactgggccctacgttatctagttcccaactatgtttttgacctcatccttgactttccctcactctgctttagcctttttggacttctcgctgttccttgaataacccaagcactgtcttatacaaaggcctttgtattgctgctattcactcagaatgcgatcaatccctcctgacatccttcatttcatttgagtctcaacggcctaagatatgatgcagaggccttctct

SEQ ID NO: 10046 - DNA, 511 bp, artificial
  synthetic oligonucleotide
gtaatgggactacacttttgagactaagttatgatttctcccttgctttctttttctctctcctttgctcattctgaaggaagtcaactgccattttatgagctgtgagctgccctatggagaggtccacatggtaaggaactgatgtctctggccaacagccagagaggactgaatccttctagctaccacagaagtgagtttggaagcagatccttccccaagctgagccttcagatgagaccacagaccatgcactgcaccttgattgcagccttctgagagaccctaagccagagacatccaactacaccatgctcaagttgctgacccacagataccatgagataataaatgttgtcttaagctactgattttggggtaatttgctttgaagtaatagatagctaatgcaatcttcaataatataatgatctaaaataaaatacttttgtttaccatttattttttattatggcaagaatgagaaaatctctggaaaatctttggg

SEQ ID NO: 10047 - DNA, 803 bp, artificial
  synthetic oligonucleotide
ttttttgttttgtttttttaactaggttaatcattttacggggtattgtgcaaacaggacgatggtttgtttgttatgcttatttctgatctcagaaggagcaaatatcctagctgaagagttctagacaggtaccaagggagcctgggattttgagctgcaagggctgtgtgcagcagtcagaggagatgcatcctttatgccattatcagccactctacagttctaattttgatgagaacaagacaattgttaagcgaagtgctccttacttaacagtttaatcaaccatagcagaaacagcctcccctttttctggtcagcaatcacttgtgtctcctgagagaggggagaggaagagagaaccttcagaaaatagcgggtaaaagcagctgaaggaaattaaatttgtacttaacaaaaaatctctgaagcatgtatagtctaatagaatcaagagagtctacagctgggggccctgcaccactatcacccactgccatttccaagggaggggatgaactaggattttttcagtctcatagtgttcagccaaggactgctaggttgttaaaatcatctaacatccttccaccgcgtcttatatatacatcctaggatactaggccactgtttctcaaagtatagtctttgggacacatctatcagaaccacctggaaaatttgttttaaaactgaaacagaattgctgacagtgggaccaagggcatctgcattttccttaatttgactaggtaaatctatcacatcctaaaagacaagaactgctgcccttatgagga

SEQ ID NO: 10048 - DNA, 941 bp, artificial
  synthetic oligonucleotide
aagtatacagagcccaaagtcaagatcttccctttcctatcccagtctctcttcctcaatcctgtttccttctccagtttggggaatagtaactgggtgctatcttagatccattttatatacacccaaaaatacatatacaaacttattccttttcttctaaaaaaaaaaaggatcatgccttatacaatatagacttgctctattttacctagaaatggttgtacctccttaacaacaacaacaaaaaaggtggagtaatacatcttccagagtgttttttgatgactgtcttactgatgatggtcatttaggttgcttttttaaattacaaattttttgtaattataaataatgctgcagtgaacatctttatgcatatatttttgtgcatgtgggcaagtattgctgttagtaccaattcctagaagtgaaattactgagtcaaactgaatgggcattttaaagttttcatagatattgacaaattgttctccagaaataatgtatcttgtttcttcttcggtgtactgtatcttggggtttcaccatattagttcatacttttatcatttaaatttagttaaatatttaaaaattcctaagtttttactatacaaattttcaaacatattgaaaagttgaaatagtagcatagtgaacaatgactgtacatcctccagctagattcaacaatatctaacatttctccatattcacttcctatctaaatttgctgaatcatttcaaagttgcagacatcttgatgcctcagtctaagtacttcagcctgcagctcctaagactaaggacattctctcgtataactacaataccttaccacaattaagaaaattatcaacatttctataataccatctaccttatttaatcagcttacatttaaatttccttgattgtcccaagaatgtcttttaaaa

SEQ ID NO: 10049 - DNA, 2310 bp, artificial
  synthetic oligonucleotide
catagaaagcattttataccaaagtagtatctgccaatttaaattctaggcagtctaaggaactgacaagggggtcctgtaagtaaattcatatgaatttctctttgttagaataggaaatcattttctaatgtttaaatattgctagaaaaacaaaacaaaacacttacatgtaaaatcagtcagctgctccatcacccatatgatggatgggtaagctttaaacaattacagtttagttcacatatcaaattcaaatatattcaattcaaattggcaccttctcaagaatacacctcacctaattgagaaggaacgttaacatttgtcaaagttaatatataatgttatatagtactttaataaaaatgaacattttaagaaaagatattaagagtttagctatgaaagaaccaaagagtttgtgacagtgcctggaaactatgctaaaaagaaaaaaaagtcgctgaaaagaggcaaaaccttagatattacaaggctcatcgtaaacgatagagcatgtaacagaaataatttaagggactctgtctagtcatttgctcacttgttcattcactttctaaaatattgttgaccttaatcggttaactgctggaaagttatcaaactgagaggggcttcatattacatataactattattcaggacaaggaagtaattaaaacccaaattaaaaatccctgtttggacaggcaaagagaagcaattcaactatgttttagtctaaaactaaaagcagttttttcatgaggggtttcaaccaccaggaaattccatattctgtcattccctgctagagcttctggaatagaatgcatacatggcatgtttgaaccccagaaactcagaatactagaatcctaaacccacatctgaaaaattatctaccgctctgtctcactaagtagcaattttagctttctaaaattcacgaagtaatggacacaaaacaaaatgtaaaaatgtgcctattcatcaaacctaagggtagagaggaagaacaaaagacacaattatggttaaggaaggaggaaaggtgccttattttggtgagggctgttactcaaaagaaaagtttcaattgtaagctatatgtacagtgttacttaactgggagatgtttttccttttacagtaataataaaaccttcttgctgctcaatgaccattaacatttattaattttaatatatatgcttaatatgatatgatgggtaattcatggggaatagaggaaagaactaagggatggaacaaaaggaagagaagataggagagaaagaaagaaaaaaacaaccccatcaaaaagtgggcaaaggatatgaacagacacttctcaaaagaagacatttatgcagccaaaaaacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacccttttacactgttggtgggactgtaaactagttcaaccattgtggaagtcggtgtggcgattcctcggggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaacatcattctcagtaaactatcgcaagaacaaaaaaccaaacaccacatattctcactcataggtgggaattgaacaatgagatcacatggacacaggaaggggaatatcacactctggggactgttgtggggtcgggggaggggggagggatagcactgggagatatacctaatgctagatgacgagttagtgggtgcagtgcaccagcatggcacatgtatacatatgtaactaacctgcacaatgtgcacatgtaccctaaaacttaaattaaaaaaaaaaaccatattatccaattctggaaaaaaaaaaaagaaagaaaaaggaaaaaggaatatgtaaaaagagaaaggaagagaaaagcaagaagctgaaaaaagaagtaggagtcaaagaaagtacaaaaaagggggacacttagaaagggctcaaatagaga

SEQ ID NO: 10050 - DNA, 1140 bp, artificial
  synthetic oligonucleotide
tgagagcaattattaaagatttttaaaaagtaaaccagtgatacttccatctcttgggttattgtattgctattaagaagaatgaggtagatttttattcaaatggaaagatatcaaaaatatactgtcgagtaaaattagaaaatcacaaaacaatatataatatggtataatttatgtagaaatatatatgtatgtgtatgtgttcttatgtataattcacatttatgtatatgcatagaaaaaggtctggatggatataagtcaaattcttttccttgttgctaaccctaagaaaggggaagtaaaatgggcagggaaatgcatatgaaaacaggtttttacttttcactttttgtaaaatttgaatttttcacaagtatatattacttttaaaaaactaaaagccccttatgccatttgctgttatcatccccaggcctgaactgttaaatgagcaaaagaaattcagtgataagatctcattggccttaaaagaagaaaataaaaataaagtaacaacaataatagttgccatttgtccaacaattatcttgagttagatatttcacaggaattatctaatgcatgccttataataaccttgaaaagtaggttctgtacccgattaggtatgaaaaaactaaatctcagagagattaattcgtcagaggccacatagctggtctcttagcctgttgaggctgctatatcaagaataccccagattgagtggcttaaacaacaaacatttatttctcacagttttggagactgagaagtccaagattgagattagggtgccaatgtgctcagtgtggtgcaggccttcttcctggtttcctcacatggcaaaccccattacctcctaaccccagttgccctctcaaaggtctgacctccaaatactaccacattggagattagggcctcaacgtatgaattttgaggcaaacaaagttcagttcatttgtgtttttataccaaattcagctggtaaaagcagttgggcaggaatttcaacctggatttatctggctcttaaacctgtgttgttattactgaacaacatagcctaattggaagtacataaatggagtttacgatggtgtcagggactgtttttagtatttttatact

SEQ ID NO: 10051 - DNA, 1487 bp, artificial
  synthetic oligonucleotide
tgatggtttcaatttttccacatcttcatcaacacttgttattttattttatttttattttattaaattattatttttattatatttattttattttttatttattttttattatagccatcctactgtgtgtaaagtagtatctcattgtggttttgatttgcatttctctgatggttaatgaggttgagtatcttttcatgtgtttattgaccattcttatgtctactttggagaaatgtccctacaaattctttgcccatttttaaattgggttgtcattttattactgagttgtaacagttcttatatattctgcatgcaaatctcttgtcagatatatgtttgtgaatattctgtcattctgtgtaattttttttcattttcttgaagctattattattaaatagaaatttgtaagttcgcatataataaagatgacagattgtattagaaagaatgagatctaaaatcacctgatgcaccctatggtacactaccctgctcctgcactcctttgaaattaaattcaaaacagatcaagcttctcctctgtgccaggcactgtgggggaataagacctaacctctattctcaaagagcttcataacacagaagagaagatgcaaacatgtggaaacttaaataattataacatgtttaaatagcagttcaggaccacaacagaaaagatgccacagagcactatatgattaatttccaaatgaattgcatggaaaagaattgctatgggaactcaagggagggagaaagcacttggggctgaggtggtcaggggaagctttaaggagaagggatctaagcagtctgtaattaactaccgccatgcctgtgtaatactaaacaaagacttggagagaaaaaaatattgactgtttttgaggtgaggcatcttagtgattaaattgataccaccatttcttttcaacctctgcaggaatccccacagtcccacctttccaatgaagacttacgtggcctctgtctagtccagaggttaccaattaacaaagttaacaagccacatctggcttacagacacgtttggtttggtccaattaaaatattagaactagctgctaaaacatttaactggacaaatttcacataaaatattaatttccagtttctctagaaaaatcagaagacctggctaccctgcattggaacatgcattctctgggaccatggccaatggcaaccctgcttgcacatgcagaattcagtttgagacttcctagaatcatagttcttagactaaaaggtatcttaagagtgcatctgtttctattccctgactttgggaatgtatggtattataatattaccctcaatttacaacttgatttagaatatcaactaaaacccacagagaatttgacttgctgcaggccacagggctattaactggaagagggagggctaaaacccatgttctctacttctcaacggaatgttctttcaac

SEQ ID NO: 10052 - DNA, 311 bp, artificial
  synthetic oligonucleotide
ctagccccatgtcccagcctcagacaggtatttgctggagaattctgagactttcctattccccttgcctgtagcaagatgtcccttttctacagctaccaaaaggctagactgccactgttgctactcctggctgtggcagaaagacagtgctgtcacaccaaagaaaaaacctgtgacctggtagagaaaaaggtaaagagtcagggaacaagttggctctactgaagtggctgaaaccagtgtttaacaaaagctttgagagcactgtggaccagggcccagatatatacatatacatgttcagggca

SEQ ID NO: 10053 - DNA, 344 bp, artificial
  synthetic oligonucleotide
aatctgttattataagcattgcataatacttcatggcatgcctctaccacattttacctatccactggctcagtcaagtgctccccactgggattctgctaccttcggccaccacaaatagcactctcatgaacatcctcacacatgtctccccatggtcttatgtgaggattttcctggataatatactcaagagcagcattgttgggtcataggatatatgtatattaatattttaatgtgactacattagttatatgaccctcaagccagtgcagcctttcttggccactgtttcttcaattgcaactcccatgtaacatttaaaattccccctttctttt

SEQ ID NO: 10054 - DNA, 908 bp, artificial
  synthetic oligonucleotide
atagtagccacgaggagaggaaagcttggcctgatgctgtggagtgttgaattatttgagctattcacacttactgcttctctgttggcaggttgccggaagatatcaccatcagaatgttcccatgacagttctccatctcctgtttattaaaaagaaataaggagaaaatcatacattcataaaagggaaagttatcacccttgtgacccagcaacatttttggtactatgatcccaaagttcttgaagtgtttttgcttttgtggctgtccttcaaaaagcggctgtgaaagatttctctgggtgtgcctcatttttcaaaacaactctgaagaaagttgccactttctaaatagatgtcctagcaacattatgcagaatttggaaaataaaaggaaaataatcactttccacctaatttaaccatcactgtcacttttgctcattttacttcgtgacagttaagtgttttgcaggtcataattcacttctgtttaaactaccattaaaataatgagttttgaggatttgatctgtcataatttcttatgacacacctttctctaggtctacatgacccactctttggacagagaactccttatcattatcttctaaagtaactgcttataggaagaatattctactttcagcctctagagcaacaaacacacaagagctgtggatatacctcaactgattaaaaaacaagaggatcatttccaagaatattgcccttgtgttacctctgaccaagcaagcgaatgggaagagccttgtcttagagatgtttgcatcacttgaaatgagtactatttaaattatatatatggctgaagataaacctaatattcaacatatattttataagataaccagaaacacaaaaaagtgtaagtactaaga

SEQ ID NO: 10055 - DNA, 2174 bp, artificial
  synthetic oligonucleotide
tgtctaaaaaggcagtgggttccaagtcaatgtgcctggagtgaggagatttagcttcacctgctggcactgactttccctacagaagatgtagctctgggcaccacactcctagcttacatttgatccctcctgctgaagcagtaatcaatctgcagtcttctgctattagatgttaatgcaatcaaagagatcacaatgaccttaagatttcctgattaattcactttttcccctagtcagcattaccttctttaatttctcagcacttggctcgttttctcagctcacttggctctgtttcatgctacaagtacctttttcctctactgaggagagggtttgggtagagtgatggcgttctgggctgcctggtagtggaagatggagaatccctgtccttgaataaaggtgtactacccaaaaagaaaggttttggggttttgacaaaaagcaatcttagaaaaggacatttggaaatggtaagagaaagacagagagagagaggatgtgtgtgtttgtgtgcatgtgtgtgtatgtctgcgtgtgtgtgtgtgtgtgtgaaagagagagagagaaatcttgagaaactggtaggaacaaagtaaaattattatttcctctcaagtcaaagaaggtacagaaagaaaactgccgaggtgaagatacgtatcagggattaccaattttccagagccccccacgcataaagtgctttaagatcctcagtgaggagaagcttaagatacagagactgatgatctgccaccataggtgggcagctggagttgatacaagctgcccaaagcagaatttgtgatttttttctgcaaatacattcctcttccagtcaaccccactcagtaaatggcactaccgctcacctggttgcttaagtcaaactcctggtggttatcctgagttcttcttgttcccttacacatcacatcctagtcatcagcaaatcctgttcatttaccttgaaaatatttactgaatttcatcacttttcaccacctcctcagccattagctagtgtgagccaccatcatctctttcccaaaccactgcaacagccccctaaataatctacttgcttccgctcttactgccaggcctgccatgtatggatgttcaggttgtatactacacaagggcaccatagctatgggtgtgccatttatatcacagacacatacatacttacataagattgtgcagatgggtgcagacattctgggcttcttggctctaagtctgacaacagcggaagagagcctgctcctacttaaaactgtaccagtgcacatggccttgcatagactcaggaaagcacaatcacacacacacatacacacacatatacatccataaatgtacatactcagtggcacacacaagtggactctatcctacccaagccctgggtgtcccctgagtttacttctctctctactacccattgttcccacaggctgaagtcccatccctcccacttccagctgcctcagctggagaggggatagaacagtggggggcaaagtgttgttgatggtgcatctattccagtgacaagaaatgcatgagtgagaggaataatgtgggtgctcacaacacaggctgctgcccaccatgactctggcaaactttcttgggcaggacttaaatttgtttaggttgtacaagaaaagactaacataatttttgttgtcatttttaaaatgaggaaggggtgtcttttttgtgattcacacagacactgtatcagatagtggcagccttacgcccccccgcccccgccaaatctcaactccaaccaatctctactctatataacagtcactaagaactttaacaaacaggctgggtacaggggttcaagactgtaattccagcactttgggaggtcagggcgggcaaatcgcttgagcccaggagtttgagaccagcctgggccatgtggtgaaaccccatctctactaaaaatacaaaaattagccaggcgtgttggtgcacacctgtagtcccacctactcaggaggctgaggtgagaggactgcttgagccctggagatcgaggctgcagtgagctgagaaaaataaaaaaataactttaacgaacacttgagtatgttgattctttgcttaaagccttccatttatattttaatgtt

SEQ ID NO: 10056 - DNA, 1084 bp, artificial
  synthetic oligonucleotide
tatttctgcaacaaagcatatgaatagttacactgagagtgcctcatgtcaattcacaacaagttttgtcaccaggcaagttttagcaacaaacttatgaaaaactgtttggtcttcagagctttctagagtttgtaattattaatggtggactgaaacttgtatctgatcacatgagattgttctagggattacatgaaatgcattatgtgtagcaggggtcctgatgagagtgaattgatattctgacacatctgggtatgtgaagacccccatatgtttattttcttgagataatctgcagaaggcaaaaggctttatgcagaggagggctgtgtcagaaactgaatttgtagggatggaggagcaatctgataagatatgatggtgtttgttctccaaggacagtaaccaagtttgaaagtctgagctagggtggtgggagtgggttgttggggagatgttgctgcagtaagaagctgaagatgtttttctcacaggagcctcactcagatacaggttagaagcaatattgtttcagtgtccaggtgacaaaattatagcacagaactgaaaggggcattcctacccttctatgtagacccattgttggtttcagacaaagctgccagaaaagagggcagcaccatttaagcccctcagggatgtgtagctgggagcacttcagaatccatactcccccacagtctagcgggggcctccatgttcccacagccacaggtactagtaccatcagtagctggactgggttggaggggctaccactatctttcattagaaacacaagctctgtctagtgaaaatggacacataacataccaaaacttatggaatgcagcaacgttccctattaagagggaagctgatagtagaaaatgcctacatcaaaaaagaagatcttaaataaataacctaacattacacctcagggaactagaaaaaagaacaaactaggcccaaagttggtagaaggaaagaaataataaaaatcagtacagatacaaatgaaatggagaatagaaagtcagtagaaaagatcaataaaagtaggagtggtttttga

SEQ ID NO: 10057 - DNA, 1185 bp, artificial
  synthetic oligonucleotide
aaaaatagttattatttttttaggttggtcagttatttgaaacaccaacttgctaggatagcctgtgtattggtttttgttttctcctaagatattaactgtttcttttgagattggttctattggttttgcttgtagaattaaaatgaagtctatgttatggctaaaatattccattaagttagaaaaaaaaatgatgatctcactgtctggagataaaacaaatagatatttacctatttaacatatatttaccaactgcctccttataagctctaggaagtttggatatcaggctggtaggggaaggtaaacatggacataaagaagtacaatacagtatggatagtggctgagtatagtggttcatgcctgtaatcccagcactgtgggaggtctaggtgggcagatcgcttgagcctaggagttcaagagcaaactgggtaacatggtgaaaccctgtctctacaaataatgcaaaaactagctgggcatggtggtgcacacctgcagtcccaactactttggaggctgaggtgggaggatcacttgagccctggaggtggaggctgcagtgaggcgtgattgtgtcactggactccagcctgggtgacagagcaaaaccctgtctcaaaaaaaaaaaaaaacccaacaatatggatagtattacatatcataaaatatgttgacatgctatgagatttcagagaaagtagattgcttttagctggggagggaaagggaagcaggcccttgtctccaagggctgaagctcagtgtctggtaccaaatagatacttggtatgtatttgttgaatgttaagttagaaaatgcttcatataaaagttggcatttgagctagatcttaaaggtcagatgagatttcgatctgtgaagatgggaagggcattttaagtaaaaagaaaagcataagaaagggtgtgttggtgagtagagcaaggaaacaaggaatatggggttgaatgaaaactgagatgcgagaaagggaatcaggaaataagtcttgaaggttaaggcggaaccaaatcatacaggcccctaaatggtactccaaggaatctggctttccagtattcagtgggaagcttttgaagtgttttggagcaggagagttaagtgattaacacttataccttgggaagagtaatctgacggcaaatgtc

SEQ ID NO: 10058 - DNA, 1421 bp, artificial
  synthetic oligonucleotide
cctcagctttcctgaccagtgtactgttaacccttgaacctgaaattacttccttctacccctcctcctgcaccaaccctcctgctggctagttgaagatgtaagagataaggggggttggggataacaagtgagcaacatagagctcaacaaggacaggaagcatgttctctctccactcactgggcccataccaatgttttcataaaacagttctgagcatttctataactctggtctctgagatctccttcttggcatttccctacaactccctctgtaccttctatgccaagatggaaattcagctagaggtagggcacaaggaaacaggggtccagggcaattaggcctctaaatattggcaaccattcagctagacagtgagatagtcctcaagcaaatatccctggtatggaattttggttttaaaatcaacggaggatgttttgtctgggctcatattctttagccatcttttccaccttcatacttgtaaatctagcagggaatcacagaacctgggaattggaaggaaccttagaagccatgtttatcctcttgctcagtgcagaaatatccttctgacagtctgagaaactcatccctatgcaaaacagcttattccatatttgatcatttcctaattgttaaaagggtcttccttaggttgaggaaaaaatagcttcacacaaacaatttctaattcctctttcacatgacagccctttaaaatatctagcatgtcacgccaagtcattcatcctctgggctaaatatcctcagttctttcaaaccatgcctcataggacatggtttacagactttttgccactctagttgtcttttgagcataaatctactcagtgtgcagcccgtagcttaatcaaaatcctctgttgtttcttgcatgaactactactatgtgcctgattctaggtttgtacaattgacttttaattttacctggatgctgggctttgtattcattctcaaaaaccattgccttgtttattttaatctatctccttaagatctttctttatcttgagcctcatatacaaaatcatattctccatagtaatgtttctcaatctttttttatcattatcacggtcctaaagagcctttttagatatttttcccaatgtctctccgtgaaattttaataccacagatatgctgtctatctgtttatttgctgtctatctgtttatttgctgtatgtatatctctgtttcatgtaaaaaagaaatttttttttcactcttcaagaatcaatttttgccctcttgggggcaatatcacccccattgagaatgcatgatctgtatcaataaatgttttatatgtgtatttgatcagccagactgatgaaagtattgaatgagagggtccaggacagaatactgcagcataac

SEQ ID NO: 10059 - DNA, 515 bp, artificial
  synthetic oligonucleotide
ctaaagacaaggaaatgttgtcctaatttttgcaaaggggaagaagtatatctcaggaaatataaaccaatagttaacttgatgccgatacccagataaaaattttaaaagggatattagaatacagtttttgaggactcaagaaaaattataatcagtatacacaaataagggttgatggaaggcatgccctgccaacttttcttttgataactatactagacatctaggagtgggcatggcctgggttaggactggcaaaacatctcccttcagagtccatggcagaaatcattaacccctcacagcactcttgtcattgagttcttattcaacctcacattccttctcagtaagcagtcacagcagaccaatctgctgtcccaggctcagggcctggggatgcagagaatacagaagatccttagggaatgtacaacatagtagagaaagtatgtaggtattataattttgttatcttacagaaatgggacctatctattttgttctaagga

SEQ ID NO: 10060 - DNA, 853 bp, artificial
  synthetic oligonucleotide
acctaggtctattcatcaaataaataatttgataggtttttttaaaaaaatgaatttagctgctgactggatatgctacctttgtcatagcctggaaatctctctactgggcaatatagagattttttcaaaagcttataaataccaagcccatttttcctaatacacaggagcccaaaaagatccctagggtttcaggctatctaataaataatctacatcttttgtttctgaaaagaagaaatcaatcagcccagctggcttcttagattagctttctaactcagagagaatttatcatcactcttattactgtacttagcttggatgtcagactcaatttagggttcagcactgagaatcacaagtcacagatcagctaactgtgacattaatcaaatgaatccagtatatgagggatagagccagtatgatcctttggcaagtagagactttcccaagttactaccttgcacattcaaaaaaataatttgtgcttgggcacagggtaagactagaaaatggtgggaaggagggcttacaaaagcatggaaacttttgaaggtgatggatatttctatttatcttgattgtggtgatggtttcacaggtgcatacatatgtcaaaacatatcaagttgcacactttaaatatttttactgcatttcaattatatctcaagaaagcagctttaagcatttgaagatatacattttttaaaattgcatttactcattgagaaaaattatcatatggcataatttctaccttaaccccagtggctaagataactgactgtggagttagacagacctatggctgtcacttactagctgaatttctttgaggttt

SEQ ID NO: 10061 - DNA, 2215 bp, artificial
  synthetic oligonucleotide
caagcgcacccactcccttcacgcagccagtcacacacaataagagctagggaagaaactgacacggggaaactgacaggggtagctgacactgtagtgtgaaggagagggagaaggagggaggaaggaagggatggagagagaggggagagagagagaaaaaaagagagagagccgcattcacactcttacacgcacactcaagctccagctgttaggtagcggctggcgggagcgctggctacccctccaaaacccttttctacactagaggtttctgtccccttctgctgccgtttctggaatatgctatacagagaaggggagagaaaagcaaagaggggtggggaggggaaaatcaaggaggcacgctccctttatcctccccacccctgtctccaaaaatgtccaaccctgagctcttccttttcccttctttctgcgcccggcttccctctgctcctgttctttattcctccctttggggtggctgcgagctgcggacaacccgtcgtggttgtgatgtggggtgtgtgtgtgtgtgtgtgtgtgtgagagagagagagagagagagagagagagagagagaaagagagagagagagagagagagagattgagacaaccgtggtaggcaaaagcacccctcacctcccccagcccccgggccgaagccactctcaatctcctggcggcggggcggggcgggggaggcggggaggcgagagggaaagagggaggacggggcaggcggcaggggcagcagctcctgccttctttgcagctccgcggccaggggtggaaggaagccgcagccgcagccccaagtcaacccccgctgccccgtcccaccgtctcatctctcccccctcggtacggaattttctgtctcgtttgtttgcttccccagacctccccctcccctgggtggtggcagagacgggaggggaggtgggaggctaagcgcgggtgcgggtagaggggacaggagtccctcggagcatatggctagcagagtctctctttgccccttggcctgaatatcccctgctttgggcagtgacctttgcccacccccgtcagcctgggctctgggccggtggtggcgaggctgctccggcgaccataggtcattcaggaggaaggggagttgaacctgggggagtaagggcggcgggcggctggtaggacagggagacagcggagcgctgagtcgccagggactgacctggggtcctatggggcaggcttggatccctgatagatctagattaatctagttggagctacctaattctcccatccgtgcccctctcacccatagggtcgatctcccaagatccagcctagattgatacagggagggaaagtgatattgtaggatgggggcggggggctaggttgcttagtggtatctgttgtggagggagaggggcggtgtcaccggacacttgggccactctttgatctttacgccttcctttcacatgaagcacctctccacttctttcaccttatagcctggcgctcagaatgtccaccctcttgagcccaactggaaggggctaaatagccccacccccaccacaagcctgagacttctacctgcaacctgcaggcgcataggtccactagctggcagcatttcatggcctggccgcacagccccaaatattggctttgtcttttatctcccttcctagcgctctcaggaaaggggcatgtgagtctctgcctttctggacgccgggctggtacctgaaaacctttccctacccattctcagaacaatccctagctctgagaaaactccactgtacttcctgttgctctttaaccccctctgcacgccctgggagcctaagtgtaagctcccgaaaatgccagaatcatctcccttgcctaaatggccgagtgttttcattgcggagcctgtgaagctggtagtagctatgtttagtggaagccctaagcactctcctcctagcctaccttggaaaagtcgctcggggcaccaagcaagacaaattttccccttgtcgttagtcctcctagtcccgaggcagtccaatattctggagagtatttagcttttgtatgggagcaaggtattggagaaaagaaaattattaccctgggggatgaagagtttgtgtctggggggaagggagttggggaggaagaagtgagggtggagcttccacctcttaacaact

SEQ ID NO: 10062 - DNA, 6832 bp, artificial
  synthetic oligonucleotide
atgaatcataaaattagggttctggagtaagtgatttttttcattttgaggaccactatcacagttacagcttgcaaatagaacagaaactacatctggtccttataaaatgtgcctattgtctctatcctgactcagcagatagtagatttcttcagtactacctagccagccattttctacccctatcataccacaggttcttctctccatttgtagaatgacaagcaacttaataacccttgcagctctgtgtccattccctttcatcctggtgattgccaaggacttagcaggcactagtgtgcagtaatgcttacaagtttgaggagactggatagacaggtggatccattttcctaacagatatattctgaaagttctcctactgcccttatgtcaagtgtgtgctgtatttacaggtcttgttttctgtcaggcctctgagcccaagccaagccatcgcatcccctgtgacttgcacatatatgcccagatggcctgaagtaactgaagaatcacaaaagaagtgaatatgccctgccccaccttaactgatgacattccaccacaaaaagaagtgtaaatggccagtccttgccttaagtgatgacattaccttgtgaaagtccttttcctggctcatcctggctcaaaaagctcccccactaagcatcttgagacccccactcctgcccgccagagaacaaaccccctttgactgtaattttcctttacctacccaaatcctataaaacggccccacccttatctcccttcactgactctcttttcagactcagcccgcctgcacccaggtgaaataaacagccatgttgctcacacaaagcctgtttggtggtctcttcacatggatgcgcatgaaatttggtgctgaaacccaggaatttggtgccgtgactcggatcaggggacctcccttgggagatcaatcccctgtactcctgttctttgctctgtgagaaagatccacctatgacctcaggtcctcagaccgacaagcccaaggaacatctcaccaattttaaatcaagtaagcagcctcttcttactctcttctccaacctctctcactgtccctcaaccactttctcctttccactcttcaatctctcccttctcttaatttcaattcctttcatttttctgggagagacaaagcagacacgttttatccgtggacccaaaactccggcgccggtcacggactgggaaggcagccttcccttggtgtttaatcattgcagagatgcctctctgattatacacccacatttcaagggtgtcagaccacgcagggacgcctgccttggtccttcacccttagcggcaagtcccgcttttctggggaaggggcaagtacctcaacctctgctatccttgtctctaccccttctctgcttttctgggagaggggaaagtacccctcaaccccttctccttcactcttagcggcaagtcccgcttttctggggaagggccaagtaccccaaccccttctctccttgtctctaccccttctctgcttttctgggggagaggcaagtacccctcaaccccttctccttcactcttagcagcaagtcccgcttttctagaggaggggcaagtaccccaacctcatatctctgtgccccaatcccttatttccatgccccaacctcttatctctgtgccccaatcccttatttctgtgccccaaccccttatttccatgtcccgaccccttatttccatgccccaaccccttatttctgcaccccatcccttttttccatgccccaacctcttatctctgtgccccaaccccttttcccacttttctggaaggtaagaacccccgaaccccttacctccatttctctactctctcttttctctaggcttgcttccttcactatgggcaactttccaccctccattcctccttctactcccttggcctgtgttctcaaaaacttaaaacctcttcaactcacacctgacctaaaacctaaatgccttattttcttctgcaatgctgcttgacaccaatacaaactcgacagtagttccaaatagccagaaaatggcactttgaatttttccatcctgcaagattctaaataattcttgtcataaaataggcaaatggtctgaggtgcctgacgtccaggcattcttttacacatcagtcccttcctagtctctgtgcccagtgcaactcatcccaaatcttctttctttccctcccgcctattccctctgtaccaaccccaagcgttgctgagtctttctaatcttccttttctacagacccatctgacctctcccttcctccccaggctgctcctcgccaggccgagctaggtcccaattcttcctcagcctctgctcctccaccctataatctttttatcacctcccctcctcacacctggtccggcttacagtttccttcggtgactagccctccccctcctgcccagcaatttactcttaaaaaggtggctggagctaaaggcatagtcaaggttaatgctcctttttctttatcccaaatcagatagcgtttagtctctttttcatcaaatgtaaaaacccagcccagttcatgacttctttggcagcaaccctgagacactttacagccctagaccctaaaaggtcaaaaggccatcttattctcaaagtacattttattacccaatctgctcccgacattaaataaaactccaaaaattaatttctggccctcaaaccccacaacaggatttaattaacctcaccttcaaggtgtacaataatagaaaaaagttgcaattccttgcctccactgtgagacaaatcccagccacatctccagcacataagaacttccaaatgcctgaaccacagtggccagacgttcctccagaacctcctcccacaggagcttgctacacgtgccagaaatctggccacagggccaaggaatgcccgcagcccgggattcctcctaagctgcatcccatctgtgtgggaccccactgaaaatcagactgttcaactcacctggcagccactcccagagcccctggaactctggcccaaggctctctgactccttcccagatcttctcggcttagcggctgaagactgacgctgcccgatcgcctcggaagccccctagaccatcacggacgccgagcttccggtaactctcccagtggaaggtaagcccatccccttcttaatcaatacggaggctacccactccacattaccttcttttcaagggcctgtttcccttgtctccataactgttgtgggtattgatggccaggcttctaaacctcttaaaactccccaactctggtgccaacttagacaatactcttttaagcactcctttttacttatctccacctgcccagttcccttattaggctgacactgtaactaaattatctgcttccctgactattcctggactacagctaaatctcattgccgcccttcttcccaatccaaagcctcctttgcgtcctcctcttgtatcccccccaccttaacccacaagtataagatacctctactctctccttggcgaccgatcatgcaccccttaccatctcattaaaacctaatcacccttaccccactcaatgtcaatatcccatcccgcagcacgctttaaaaagattaaagcctattatcactcgcctgctacagcatggccttttaaagcctataaactctccttacaattcccccattttacctgtcctaaaaccagacaagccttacaagttagttcaggatctgtgccttatcaaccaaattgttttgcctatccaccccatggtgccaaacccatatactctcctatcctcaatacctgcctctacaacccattattctgttctagatctcaaacgtgctttctttactattcctttgcacccttcatcccagcctctcttcgctttcacttggactgaccctgacacccatcaagctcagcaaattacctaggctgtactgccgcaaagcttcacagacagcccccattacttcaatcaagcccaaatttcttcctcatctgttacctatctcggtataattctcataaaaacacacgtgctctccctgccaatcgtgtccgactgatctctcaaaccccagcaccttctacgaaacaacaactgctttccttcctaggcatggttagcgcggttggaattcttacacaaaagccaggaccacaccctgtagcctttctgtccaaacaacttgaccttactgttttagcctagccctcatgtctgtgtgcagtggctgccactgctttaatacttttagaggccctcaaaatcacaaactatgctcaactcactctctacagttctcataacttccaaaatctattttcttcctcatacctgatgcatatactttctgcttcccggctccttcagctacactcactgttgagtctcccacaattaccgttgttcctggcccagacttcaatccggcctcccacattattcctgataccacacctgacccccatgactgtatctctctgatccaactgacattcgccccatttccccaaatttccttctttcctgttcctcaccctgatcacgcttgatttattgatggcggttccaccaggcctaatcgccacacaccagcaaaggcaggttatgctatagtacaagccactagcccgcctcttagaacctctcatttcctttccacgtggaaatctatcctcaaggaaataacttctcagtgttccatctgctattctactactcctcagggattattcaggctccctcccttccctacacatcaagctcgaggatttgccccacccaggactggcaaattagctttactcaacatgccctagtcaggaaactaaaatacctcttagtctaggtagatactttcactggataggtagaggcctttcctacagggtctgagaaggccaccatagtcatttcttccgttctgtcagacataattcctcagtttagccttccaacctcaataccgtctgataacagctgagcctttattagtcaaatcagccaagcagtttttcaggctgttagtattcagtgaaacctttatatcccttacagtcctccgtcttcaagaaaagtagaatggactaaaggtcttttaaaaacacacctcaccaagctcagccaccaaaaaggactggacaatacttttaccactttcccttctcagaattcaggcctgtcctcagaatgctacagggtacagcccatttaagctcctgtatagacgctcctttttattaggccccagtctcattccagacaccagaccaacttagactgtgccccaaaaaacttgtcatccctactatcttctgtctagtcatactcctattcacagttctcaactagtcatacatgccctgctcttgtttacactgctggtttacagtgtttttccaagccatcacagctgatatctcctagtgctatccccaaactgccactcttaactcttgaagtaaataaataatctttgctggcaggactatgctgaatctccttaggcactctctaatcagatatcctgagtcgtcccaattcttaggctttttatacctgtttttctccttctgttattccatttagtttctcaattcatccaaaactgtatccagtccatcaccaatcattctatacgacaaacgtttcttctaacatccccacaatatcaccccttaccacaagacctcccttcagcttaatccctcccactctaggttcccacgccgcccctaatcccgcttgaagcagccctgagaaacatcgcccattctctctctccataccaccccccaaaaattttcactgccccaacacttcaacactattttgttttatttttcttattaatataagaaggcaggaatgtcaggcctctgagcccaagccaagccatggcatcccctgtgacttgcacatatatgcccagatggcctgaagtaactgaagaatcacaaaagaagtgaatatgccctgccccaccttaactgatgacattccaccacaaaagaagtgtaaatggccagtccttgccttaagtgatggcattaccttgtgaaagtccttttcctggctcatcctggctcaaaaaacaccccccactgagcaccttgcgacccccactcctgcccgccagagaacaaaccccctttgactgtaattttcctttacctacccaaatcctataaaatggccccacccttatctcccttcactgactctcttttcagactcagcccgcctgcacccaggtgaaataaacagccatgttgctcacacaaagcctgtttggtggtctcttcacacggacgcgcatgaaattttccacagccacataccatctattgcatagtgctgttatcggcccagcacagccaggttctgccttgtgcctactgtcttatcacattttcattatgacccaaatgtcagcacaaagtagcctactttctgttggattaagaaacaactcattctgatgagacttcaattctcagtcctgcaaaaatgaaaggaacgccttttcatgggaaggcctgacagagcactggtgccaatggcttggtttaattgctgttttccactgattgtgctgcccactagtcccaggtgtggcatcaaagggatgcttcctggccaaaaaggaaatctttgtcttaactgctctcccacccccaccctcatcccagcacgaccaaagccctctggagaatggaccacagtctacagcatcagctca

SEQ ID NO: 10063 - DNA, 181 bp, artificial
  synthetic oligonucleotide
tttgaacttatttgttgtaataattttatttaatccaatacatgcacaatgttatcatttcaacatgtaatcaatattaaatttgttaatgagatattttaccttatttgaaatgtgatatgtattctgcatttacagcatgtcataattctgaccggtgacatttcaggtgttcattagc

SEQ ID NO: 10064 - DNA, 281 bp, artificial
  synthetic oligonucleotide
aaaagctattaccttcttcctgcaatttttctaaatttgccagtaatcaaagaaatatgattagagccctctcttgtacttctacccaagttaacacgtgaaataacttccagcatttgggaatcaatgtgcaagaaaaaaacaccttaatattgaagaaaactggaactagtcctttatagcaactgttactaatttattagctgaggagtaagtagaatgtaattatagctttatgattgtcagtatcagtagcattttggagaaaacctgtagtactt

SEQ ID NO: 10065 - DNA, 194 bp, artificial
  synthetic oligonucleotide
ggtgagcctgtatcaaagaagtaagtaaaaaaatagagttgagtattgattgagataactacttcatgtccattaggaaaaattcacctttggatgattctctgaatttctgaatttgtatctcttatagagctaaatacatttcttatccttgaatgaattataatagtaactcatatatatggttaaaattt

SEQ ID NO: 10066 - DNA, 1012 bp, artificial
  synthetic oligonucleotide
taaggaaggagttaatactgtgtcattttcaaacctaggtgagatggaaaataggatattaaacacccccctatcaccaccacaacagctatcaatatacacgtgtatgtatgtgtattgtttatattgtaatcttctgagaaatctctgcgataacttataacaaacgctggagtctacataaaaacttgtggaagttcagtttagtttataaaagaaaataatgaagagaaacagagagtggtattatagcttattagtaaaatcagactactctagattataattttaacactgtttttaatgtgtcaataaaatcctgtcaacattggtatcttgccgaatttcaagtttaagacattcatttctaagccttggataaaagaaagtttaatttcacataaataaatactaactttatttttatttctaatgtacattggtatattttaatttatgtttagtttcttataagcttattttctactgtatatgaaaaacatataaaatatacaagagtcttaaaggcaaagaatagatgttcgtttttcagttgaagggacaaatgaagttcttaaataggcttttttcctttttaaaaatatttgtgttaataaaaatcagaaactaatttatgggtaataaatgtaacattgcttaaacgtaaattacaaatattgaaagattatatcctatggctagtcagaaaacttagaagtccaaaattagaaatataaaagaaaaagagtgagaacaatactcttgctttccttagaatttttttaagcagagggtaaagagaaaaatatctgtggtggaccagacatattaaacattttaatttgcttctctccctctctctctctctcgggcagtctgtaaccaataactgctataattaaagtaacctgccatttttttgtgccttcacgctactgacttaagtttttgtaaatttttaaaacaaaattagatttatattataagagctattctgtattgaaacataata

SEQ ID NO: 10067 - DNA, 2442 bp, artificial
  synthetic oligonucleotide
ttgatgaaatttgcaagacttgagaatgctgtttgttgaaatgaaatgtacaggggtgtgtgtgtgtgtgtgtgtgtgtgtgtgtgtttggggaggggtatgctatgaatctttgagggtacattcttgagaaagccttccctctctctctatccggtgccatggctgatcctggttccccctactctctaggccttgtgaatcagattaatcatcacccccacccccatctccaccatggggtctcgcgccccctgccagcaggctccagatgcactaagagaccggtccaaacaggcccgggggccacgtaatgctgagtgctgattggctgctcttggctcctcccctcatcccgcttttggcccaagagcgtggtgcagattcacccgcgcgaggtaggcgctctggtgcttgcggaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtggtaagttggagccccgggcggcattgctagccgagaccccaacgatttaggcgggggatggggtggggagcggggacaggtcccggatggctgcagcctgcaggaccgcactggccctagcggaggttggggggagggactctgaacgcgcaaatcgcgaggagactgagtctctggaagaagagaggagcttaggttccacggaaggagcatagaagtctctaaggggattgggagcgggggctcgagatgaagacgctgggcggaggcgggggtctagagaacctggcgcgggggaagccgagacagaaacggaaggcgggggtggggtctcaagaagtgaggagtgggaggagagaaaggagggaaactgaacgcaatgtcgctgagtagagggtcgggctgcggaagatgcaactgagttgcaggaccgactacaattttaagaaatccgacagcaggcaagtgggagggggcgcaaggtttgggacagtgtgtgcagagggggaaccaaggatcctttattatgttctcattgaaaagcgaccctaatttttctggcgggtctcagcgaacatccgtaactctggggagataacacactgcggatctgtgtttggtctaacagctgttagctgaatttgaacagcgctgctggtgatcacgtaagcttaagaggagaggataaaggcatccagtgaacctttttttaaataattaattagcttatctaagtcatttggttactgttctatattttgaaaaggattgcgaaaaagtctccagcgctgcctcttattcctgtactcagttttacctgacaagcagtctttacagcgttcctcggaattgctaaacatgagaacaggttgccgttcctgatgtcacataaagttcgtcattgcaaaacgtgtctgtgtgtctgtttcttttctgcgccatgccctttgccttttgcttcctgttgggtagtatgcgacttgaggtgacaaacacttgcattgtgtttgagaaccctgtattttaagcaacagagctccccaactcataattcagcgagtgacattcggcagttaaaagatttggtctggaatcactgccagtaccgcgcagcttcttcattaatattaccagtataagtcccatccaaggaagcctctgattgctgagccactaagtgcatatgccccttacctcataccttttaggcaggctaaccgagggacgttcatatatggttgagctaagatgatttggggggcggggggtgaggaaatgcggcgcactgagtaacctctgagctccccagtttgcagacaattgcgacctcacatacacggtaatgaaaaaagatatctgggctccagagtttaaatttttcatgaagaagtttacgtacatatcagccattctgacaatcaaaatatgagtgcaatagaaacaaggtgttactgtgtagttggctacatatgt

SEQ ID NO: 10068 - DNA, 1104 bp, artificial
  synthetic oligonucleotide
acgagtcacaatgtccaagtttaaaagcttcagtgacagttaacaaaggagggagtcagaaaaaaattcagtttaatagataactgattttttaaaaaaacaagaatataaaatatgtcaaaattgtttaagttctaaattcatctatctaaaggatacaaaattaacccagtacagaaacaattattgcattccttatatcacccatagaataccttccagtatctacatcctaaaaccacttacacccattgaaaacctcaaataattgtaaacaattatcatcataaatacaactctgacaagtataatgaatttaacttagtgaaaatatagtttactcatactatcgactaacttgagtagacattttttaatatggaattctaattataaaaatacttaccagtaaaacaagttgtaattggtatcaagaagtacacctatgccaggtttccaagaacagagtaaatattgccaattgtaatatacgcaatccatatcctgaactttagtttctggaattcctaaggaacaaatcaactgtgaatgtttgaaaggcttggtgatgaatcatttgtgaaatcatttctcaattttacttcatttcctatgacctctccattttattttgcaatcaacataacaggattatttcaaaaggaagttactgggaatcacttcacgataagagggacatgcaaaaccaaaaaacatttgagggctcatttactcatattagtataagcatatgcaaaagtagtaaattgattattctaggatgctctgagcagatgagcaaatactcatgaatgtttactaatatgaccccaaaactgggaactaaatcaataaaataatatacaggttttgccaaaggtatttgctgatttaaagaattttaaaaggctaatcaccaactacaagaaagattctattttgtgccacactgtcacaggatctattgtgcctacagcctggtacataagattaagggacttattcccaaatgaattgttctgatagtattaaatatgaaaagagagctttgttttaaccttgtggtgatatccaataagtagtttctgcccaggaactttgaac

SEQ ID NO: 10069 - DNA, 1615 bp, artificial
  synthetic oligonucleotide
aaaagctaaggatagtagctaaggatagtaattaaggaactgttccagttagtttagtaccaggcaatgaggtttcagatacttaatctgttaaaaaagactatacaaaaaggtatggagagtgtttttaatttggcatttatcgcacaaaatgtgtgtcaacatcagttaccttatacaagaaagtgactagtaagaacatagctttttttcatgaacttcctgaaatagtttcaataacaattcatctactagttagttatgcacttccataaggcaggtcaaaaagacagttaattttccattaaaatccatttaattttacttttcctaatttaaaaactattccattaaaatccatttaccttttatctcggtgtctgaagatgaagtacagccaaatgttgtgcttatcagaaaggtatataagcatccgatagccaagcaaacgaaagccatttctccgagatttaaaaccttgatattgcctctctatgaaggaaaaatataacattttaactttatcttacatcaaataatcaaactaaacgtgattaaaaatactttggaaagctctctgtgtgcttctctaccaagaactgggaaaactgtgtccacctcagaccatggaaacagaaataatcaagttaggaaccaatataattggaaagaaaggattctagtctcatcctgcttacaagaataaaaacaaagctaagcaaaaacccttgtagctcctcacctccccgccgacaggcacacttctgaccaggttatggcgacttcaaatagccttcatccggaagaccgttagactcacgagagtgttcttactggttcacaatggagttatgatatcatccatctccatagcaaccgtctcccctagcaacacataaaacacagtcaaatactcttttctgaggggaaaaaaagaaaaaagaaaaagaaaaaagtatttgaaagttatttcggccgggcatggtggctcatgcctgtaatcccagcactttcggaggctgaggcgggtggatcacctgaagtcaggagtttgagacagcctggccaacatggtgaaatcctttctctactaaaaatgcacaattagccaggcatggtggcgggcgcctgtaatcccagctattcggaaggccgaggcaggagaatggcttgaacccgggaggcggagattgcagtgagccaagatcccaccattgcactccagcctgggcaatagagcgagactgtctctaaataaataaataaaataaaataaaataaaatagaaagttatttgaccactgagaaagctcagaacctaaaccgaagcctcagagagttcaaaactttgctctgtttcctcataaatatttctttttttagtttaaaaaaagtgtttatttagctctttcgccccctgctggacgattgactttcttctttgctccttttttcttttaattacttcttttaattaaaattttttatttccatctactctcattattgttccactttttcctgtgtttcctttattagtaaatggcatcgccatccttccagttgcccaaaccagaaacctgggagtcttcctcaactcctctcccatctaatc

SEQ ID NO: 10070 - DNA, 1306 bp, artificial
  synthetic oligonucleotide
agctccaatgtcatcaggcaaaattacttttaacctggattcaagattctatagaaaaacaggtataaatcagatactctatctaaacatacatgttaaatgtttatattactaattgttgtatatccaaacattttaaggagcattgaaaatgaaatctgtacgccttattaattttccaagttaaacccatttccacaaagcagatctgaaagagcaatctgacttacgttgcgaagttgtcgtatttgctctcgctcttcccgtaaatgttccatctttcttctcattgtaaatcctggatctgctgccccatattcttggcgagatgagcggctaaaagctataaaaacagaaatttcctaacttgttacaaagttaatgggaaggagcaactattgatggggaaagaggcatgatgaatcaatacaaaattacataaaatattattactcactaatacattccaaatatttttagagaatatatttgaactctatttatgtgcataattgaaagcaacagggaagataagtgtaatgatttctaccacctatacatgttcttattcaaacatacgttattagaaacttatggcccaggttaaaaatgattactgaacatatgtcagccttttatcttttaaaaaaggaaattattcttgaaggtcaatacagttattcaggaataaaaactatagttcaataccttgacaagtaacatggatccattttcttttgggcttgccaaatgcgaaaagatccctttataaaaccacaatataatggagtgctataatttcaaacagtgtttggtctgctggcagagtggtcattctaacagcagtcacagtagagtagaaataagactgcagtatatctaaggcaaaaagctgaggtttcaggagcttgaaggtaaagaggaagaaagaaatgggaatgggaattggaaagacaaatatcgttaagagaaaattgcttttaggagaggggaaagaatctatgtgtacttaagactatggaatcaatcccatttaagctgggaaactagtttcatatataactaataaattttatttacagaatatctatttacctgatctaggcttcaagccaaagggactgtgtgaaaaaccatcagttctgtcatattcctaaaaaaaaattaaaaagttaaaaataaataaataataaaacttcttttctttcaaaataatcaaggtgcttattcacatccattccaatttggggaaatacttattttcctatgattagtgaagagaaaagtaacttgcatttcaattcaa

SEQ ID NO: 10071 - DNA, 2325 bp, artificial
  synthetic oligonucleotide
ctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttcagggttgcactttggacattgtggaggtactccataaagttgagtcagagaagctatctcaatacttggtttgccggctggctgtagcccaatgatgtaattcccagagaaaggggaggagggaggggggaggagggaatagtgaggcgtgagcagcagtgctcaccataaagggttctctgctcagttgtaggaatttcctgtacggctaaggtgaaatcagcaaggaaggtgggctgtgtagccttaaaccagagctttccagctagtgcgtcccacagctgccacagtgggttacagggttgaaagaaacggtcctcagccctcagagttgccaggcagggcctgggaccacacaagtttcagggacgattgcctccttagcaagtagtatcattagtacccctaagtgtgccatggaaatgtttcctgtatactgtgacctggaaagtgggagcattgctttgaacacagtgcttgctctagccaagcctcttctcacctttgaaaatgggactggtagaccaggcacagtggtgcacgcctgtaatcccagcactttgggaggctgagatgggtggatcacctgaggtcaggagttcgcaaccagcctaacatggtgagaccccgtctctactaaatacaaaaaaattaactgggcgtggtggcgcgtgcctgtaatccaagctacttaggaggctgagacaggagaatagcttgtacctgggaggcggaggttgcagtgggctgagatcatgcattgcactccagcctgggcaacaagagtgaaattcagtctccaaaaaaaaaaaaagaaaagaaaaagaatgggactggtaaatcctgttctgtgggatgccgtgggagggagagaggataatggattgaggaagacatccatatccccttatggaaaatacctctttggttttggggaaccactcctttctagggaatttggttagggctgactcatttcctggcttcaggggctaccctgggcccagatttccagggcccggattaccagtgaagcgtcaatccctggatttttattgaaaccattggagaagagccatctcaaataaatctgccaagtatcctagctctttgcaactcactgtgtagtttttgggcatttccttcctctttctcattctgtttccctgttggtaaaatggaatggtgaccaacaagtgacctatggttacctcatagatctgccacttgtctgagggagtcagaatgcacttgtctgttccctgtccaataaaaggcttcacatgctgtggtttgtgctttatttttaggctcaattcagctagaggcacacaacaaagcagaagacaggagtaggcctggacccaagtgaagcgcaggtggggtgtgaatcctaggcagctggcttctcaggcataggtggtgacatactggggccccatgttcccgaagtaggaacgttcccactcactcatgagctcaaagtgtacaggacggcgacagaaattgcaggcagccacagacacatcctggaggggcagccccaccgcagtccaagccagcagcagcttctctgaaggtggtagggggaggggagggaaaaaatgggttagactagatcttccaaatctgtcacagtacagatgagccaagatattgatccccctcaacccttcaagatacctcagggccagaagtagcctactgtttgcttctgtgtgtgccgtgaatattaccatttgtatctggatgctgggatatatattataaaagatttggaagctctcctttgacacaatttgaagccatactgtcctggcctggaccactccctaagtataggatgtgctgtggcccaagaatgactgtctgcttgggaactctaagccctatgaggacaatgataatgacagtaactatactgtgtcattggtgctatgaccaggaaac

SEQ ID NO: 10072 - DNA, 494 bp, artificial
  synthetic oligonucleotide
ccaggatccggtttccctggtgcagccctgcaggaagggagaaaatgggtgtgaagtaactgactttaacccaaaggggactggggttaaagttaggactggcatgtcttagcagctatctggggtattgggtttctctgagcccctttcctggccacagtgtttttctgggaagcccctatcctagccctcagatggagagccagacccagggctggggctggctgttttcatcaatagataagaattctttgtgactagtgcattgattccatgtatgtcagcaggcagtatcactagggagtttaaccaggctgggggtggctgtgagcaccctaaagtttatacatgcgtttgcagcccttgtttctacagccacataggtatgctgagtataaaccattcttcaacgcttttgttaaggccctgagaatatctagactttcttgtttacaattttgtgcagctaagtgtgcttaaaaatgatgaaattg

SEQ ID NO: 10073 - DNA, 668 bp, artificial
  synthetic oligonucleotide
aaaaacagagaatcagataaaaatcaactccatttgctggccatgtcatgtatatccctaactaatctacacttgacataaggatttcagtaaaatatatcatattctctttctcctataacctagaatactgtctttgtagaacaataggttattactatgcaaatactgtgtccttctggaaaagaaaatgcattacagcagaaaattagaggaattgtgttaatgttacacttgagcctaaaatacaaagggtcttaaagactagaaaattccttcttgaggaataaattttatctttagttctaaattttctttattaaacgatgtacgtggctgggcgcggtggctcatgcctacaatcccaacactttgggaggctgaggcgggtagatggcttgagcccaggagtttgagaccagcctggccaatatggtgaaaccccatctctaccaaaagaaaatacaaaaattagccaggtgtagtggcacgcacttgtagtcccagctactcagggggctgaggtgggaggatcacctgagcctggggaggtcgaggctgcagtgaatcatgatcacaccactgcactccagcctaggtgacagagcaaggccctgtctcaaaaaaaagaaaggatttatgttagaccctcaaaaatgataataaga

SEQ ID NO: 10074 - DNA, 274 bp, artificial
  synthetic oligonucleotide
tcctttctggccatgtcccctccttctacattatactcctcactctagcagacaggaatggccaacatagaatcaccacagtttcagtactcacttgagctgcatctcgatgttaaggctgtgtaagaagttccctccaaaggcaaggcagtccacaggcgtcagcacagcatggatccaccctgcagtgtaacaaggcaaaatcaaagctggaagagggcctttcttcctctgattatctccactacctactcatctcaaacccaactcctta

SEQ ID NO: 10075 - DNA, 928 bp, artificial
  synthetic oligonucleotide
ggatgcatcctcagtgtgaatactatccagccaaggagacgaagaaaattcttccattatcctctaaactccatgttcaactcagtggtcattcttccctcctcagagatggcctctcagtataggtgataatcttgggccttatagagctcaacagtcagcagaatttccctccttgacaacaaaactaccagagtactgggatgatggtatcagaacgttctcagaagcctcagactgcttgctaaaatctgttcaaggtcttcctttcacctcaaaccatataatatcaaatgcaatatgctccattacctctgattttattggactaattacataaactctgtgtcttattagtcattttagctccagaacctaacacagtgcctgacacacagcagacactcaacaaatgtttgctgaataaacaaatgagtgactgaatcaggtcttctgatattaaatatcccacctaccttgtctatttcctcctgaccacccctacagagtttaagggacaaaatactagattacctttaggactccatggagcatcatctgaattcttctttttcttgggtcgagatttcaaagcagggtcatcatcatcagactccagtgaaggatagactgcagggagaagggaaaacagggtaaaatgagatttcatccaaagggtgaagatagaatgacacctactccagctcctgcccttcccctacaaatgtaccttttacttaatccatactcaactccaagagtctctgaatgtaccacatacatttcatgcccttctactttgcatccttgcagcaaatgtccttctcctagattcacctaattctgattcattcacccaacatccatttagtgaataacttcatgagttactttacttactcacccttcaaaattcagctttagattt

SEQ ID NO: 10076 - DNA, 312 bp, artificial
  synthetic oligonucleotide
aaaaacgcccacctggaaaacgaggaagttacgagctttgatgagaatgcccaacttctctaattcctcactgtactcatgtagttggaccactttgttgttgatcttgtactcagaagaacctcctacaagacaatgcatgagttggcaagggtcaggcctccttcctgtcccaatcaactagtctagccacctcccaggacccaaggagagctttctggccagcctcacccacctacaatgacacgggcaaaggtacggtcctcagcaccctcctcagagtagaccatgctgacaaaggcccggttggca

SEQ ID NO: 10077 - DNA, 1051 bp, artificial
  synthetic oligonucleotide
ttcaggggcaagcaatacaaaatccaactcaaactgtcttgaatagtaaatgcaattcattggctcacttaactgaagagtccacaggcagggagatttcaggcatggcatgatccggaatatggttccatttctgtgattctcttggctctgcctcctccatttttcagctccatcctcaggtaggccttccacatgttcacaagatggctaacagcagcaaccaggctacatgcttctttgttcttatccaagggaagataggtcatctcctccctcaaaagctgaataaaagtcctaagcctcattgtgattgggtcatccctgaaccagtcatcactgtggctaggagggtgaaattactcagatcagtttataccaataaaggcctacacctagagctggtggtggggtcaatcccactcacattgcatagttgttatacagcgggagaggagtggaatggatgctgcagaacaactacaatgtccactacaagggagtaaactaagaaagaggaagatatggggtccaagaaagattgggtccaacccagaataatgaagggacgtcccaggatgacagctgcaccgcaggcctacagagcaatccgtccaaattggaacaggaagacggaggactccaggaagaaggtatctggggaaaaaggggattcaaatgattttatactttccttgagactttggaataacttaagaaggtgataaagtcagacaatgcaaggaaaaaaagaaagacaattagaaactctaaggaaaaaaaggtgtataagaaaagcaatgtaatcctaatatactaattggatctttctggaacaatatttacataatcataataatgtaaacactttattgcccttaaacttttagaatgacctactggcaaagtatggatgacttaattatggttatagaacaaagtgtaaatattaaccttgttaatataaaagtgcagttgacaagttaaaagagagaaaagggagagtaagtctattagttaaaggtagaaagataaggaatagaggatatat

SEQ ID NO: 10078 - DNA, 1996 bp, artificial
  synthetic oligonucleotide
gagaggtatgtgtgcatattttttctcaggcctttgctcacagaagataccccattgggaccacatcaggagacatgcaggtttgaaatgctatggactcctgttggaggaagcactgtaaaaaggaatgaggctggattgttggccctactacatacatggttatttaactttaaaacaacctactctgtgacatgtgctgctgagtactgtgatggtctcttatgggctacggagcccagatcaccactgtgcggcaggtgtgttagaatcccagaaagaaaattgatatggggagtgttacatgggagcaggaaatgcagttggcctgggagtgaagaatgtgaaaatggcctcctctctttgatgccatggtgagagctggagatctggattgcaggcagggagcacatggcgagaaccatagggtggtggaagacaatcttgcccacacatggtatgaaactgggaggttatggagagggacagccagtaggcagcctccctcagaaaggcataagtgaccttctcccagagaggttctatctggtatcctttgaaatgtttcctgtctggcctgataattatcttctgttatctgtaagacgccagtaaagttctattaagtacacatacacagacgatacttcattcataaaaaaaagaagaaaaggatgcaatgaaaaggcatctttggagaataagaatgctgagaaatgaaaaatgactgccaaaataaaggtgtccagtagaagataaagtcaaaacaaggtcccataatatagaattaaaaaaacaaaagacatggaaaatacatatgtgagaagataatcatccaggaaatccaatatccaactaacaggagttctagaaagaacggagaaagtaagcaaagaaataaaacagcaacttctcagagcagggggacacaagtcttcagattgaaagggcccacccaccaggtgcccagcaaagtagacgagggaaaaccccactgctgggcacatgattgtgacatttcaaaacactaagtatgaagaaaaaaaaattaagcttccagatgtagagaaaacaggttgccagcaaaggaatgagaataatattagcatgtgacttttaatcagtgacactacaggctaaagcagtatcttcaaaattcagaggaaaaattgtttctaacatagaattctaaagtcaaactatcattggaatatgaaggtaaaacaatgactacatattcagatatgtaaagaccctaaaatttacctttcttaagaagttactcgaggatgttctccaacaaaatgtacgatgtggccaggtgcagtgtctcacgcctgtaatcccagcaatttgggaggctgaggcaggcggatcaggaggtccagagatggagaccatcctggacaacatggtgaaaccccatctctactaaaaatacaaaaattagccaggcgtggtggcgtgcacctgtagtcccagctactcaggaggctgaagcaggagaatcgcttgaaccctggaagcagaggttgcagtgagctgagatcgcaccactgtactccagcctgggtgaaagagcaagactctgtctcaaaatggtgcaatctcagctcactgcaacctccatctcctgggttcaagtaattctcctgcctgagcctcccgagtagctgggattataggcatgtgccaccatgcctggctaattttttgtatttttagtacagacagggtttctctatgttggtcaggctggtctcgaactcccaacctcaggcgatctgcctgcctgggcctcccaaagtgctgggattacaggtgtgagccgctgcacccagcctagaaaagagatttattatgaagttatcaggtagctcacggaagtctagagaatcaggctgagaacatggagtgggagcgaggaaggcaggcatcaggaaccacagctaagggtccaccataaaaacagcctggttagaatgctgctgttggc

SEQ ID NO: 10079 - DNA, 1528 bp, artificial
  synthetic oligonucleotide
cctgtcttaaacccggagtgattctgaagggccggggtgggggtggatctctgactccaggtcacctgtgggcctcacaccacgagaggacccctggcccaacaccctttttccgatccgcgccgcaaccacaacggtcccagccaccccctctccccacctcgagctgccctccgccccagacttcgccgctggctatcctactgcttcattccgtctcgccgccggcgaaaaccggccccggggcttaccgcgggtgggcggatcttgcaaatgcccgatttctctgcgatgggcctgattttcgcgatgtagccaagagggtctcggaactcggcccagctaggctcgaacaccgggcactccggtggcggtaggaaatcgtcggaccccggctccatggtgggcccgaggtctgggccagggatcgggaggcttggaccgcccttaaggactcatggcgccgccgctgtttgaagccgaggcaatgctcggaggctaggccctaagcggggcagccgccgcccgccgagggcctaagggggcgtgtggccgtcgtgctctgagagtctcaggctgactctactgctaccgcctcttcgtcccgctccgtttcttccaaactgtgtggttgcctccccactaccgcagccttcgccaccacagttacctcccaaacgccgcggccttcagcgccgccgccgccatcttggtttgtcagcgtctcccctccccacaccacaacaaaccggatccttccgcggggtgtccttccgagcctcgtatacgttgcgtcacaccaagccctaggaaaccttcatatagtggagaccgagctaaataggctggtatgggtttctatttggaaggggttactcaaaagtaccaccccggactgagagaaaatagttcattgcaacggcggaggaacaagattgtaattagtttgccggatcgtctttccggatggaccggcggtgcacgtttaaaggccagtgatgcgcatgcgcgttatggagaccggaagaggagctggtgtccgtgggtggtggagtcaaaccggcactcccccgcagacctcaaccaggtcgctagccccgcaccagtgttctctgtcccttctccctggtcttaacggtatgggccgcggaaggcggctctgggagcctgattgcaaaggaccccttatgctggcccgcgggatggggggagatgtactaggctccagctctagacactgacacctctggggctttgaaataaggaaggcaggaagctgctcactccccggggattatggatttttaggattctgagtcccaagtaaaggaaggaaatctttatttcatccaaggttacaggtagagagatggggtttcgattcttaccccccaaaagtcactgggagtcagcattttaatgaacgctttcaactgttctgtattcacttttaccatgtacacatttgtggcatatactcctacaaaataagcctgtgtgtatgtatactttaactattggatgttta

SEQ ID NO: 10080 - DNA, 2150 bp, artificial
  synthetic oligonucleotide
atctgagtcatcgaaaggtttgtgttatacatgcttttcagttttattttgtaaaatgttctttattgcataatgttctttaatgtttttgcctgctgggaaaaacatctgatctccacaaagtatttaaagaggcccgcttgagctcgttctccattcttgattgggttatcagctgtcagttctgtcccaaattagagaaatgtaaagctggcttcctaccatgaggctggagaagtgagctcgggaggaggatctcacgcccagcagtgttcccctggaggccctattgcattaccgacatccattgggatttctaaccagacacacctcatcacatctgggcagatgtggccaagacactaagaagccacacatgggatggtggggactgtggcgggggagcccaggaaagctcgtccatattcaggagccctggctgaagggactttagccttttggtgtgggttgtcatgactccctggggggatctttggttgactaagaggctcaggggaagatgcggctactagtcttagttaaccagaaggtggctgtctttactttgttacctaggtaaatagacacagataagctgtctgaactgtgtgtgacccagccgcctgagggacccatataccttttctccagcaaaagataggagatgctgtttgtgttcatactggggcagggagagggcaacatttgcttacttatttatttagaataaatgttctttatttatttttacatttgtaagattttaaattgacaagttaacagttgtccatatttatggaggaacacattttagagataagggctggctgagtgtggtggctcacacctgtaatcccagtactttgggaggccaaggtgagtggatcacttgaggtcaggagttcaagaccagcctggccaacatggtaaaacctggtctctgctaaaaatacagaaattagctgggcgtggtggtgagcgcctgtaatcccagctacttgggaggctaaggcaggagaatcgcttgaacctgggaggcccaggttgcagtgagccaagatcatgccattgcactccagcctgggcaacaaagtgagactctgtctcaaaaataaaataaaaataaagataagggctgctgcacatctagagcctgtgattcccactctgcgttagggcaaatgggtggtgaacaaaaatctaaaaagaaggtgtgggtttggattcagctggcaacccctgaacatggtgccgtgcacctgcctgagttgctgtgatcagtgtcagtctctgcactgtttggcacaagcgtgcgcgctgtgcgcattccctgaaccccctgcactgtttggctcgagcgcgcacgcgctgcttgcggtccccaagccccctgcactgtttggcacgagcacgcgtgcgctgcgtgcggtcctcgagccccctgcactgtttggcacgagagtgcacgtgctgtgtgtggtctccaagtcccctgcactgttcgtttggcacacgcgcatgtgctgtgtgcagtcccgagccccctgcactgtttggcacaagcgcacgtgcgctgtgtgcggtcctcaagccccctgcactgtttggcacgagcgtgtgccctgtgtgcggtccccaagccccctgcactgtttggcacgagagtgagcgctgtgtgcagtccctgaccccccgcctcccctgcgttcttttctaggaggagcgagctgggctggaggcctcactcctggcatgccaccaagttctctgacagccaccccgagctagcggcctccccattcacctccaccagcggctgtccttcctggtccggccgacaccacgcgaggtaggcacccattcccgtccaggatgccaggtttgttcagccttctgcagggagcgcactcctgactgcagaatgattttgatgtttctgatgagactgggccaccgacacataatcacagttggagggctctgaatttttgactgaaccggcaagcgtgtgacacaaaatgaaatggcaagacaaggcatgagcaagaaggggagcataggacttgggtttcagccaagcttctttgggattggccaggtgggatgccaggcagtagggttctgagccggtggggtggcatccacggcac

SEQ ID NO: 10081 - DNA, 1022 bp, artificial
  synthetic oligonucleotide
ctgatgtgattattccctcctgtctgccaccaggggatcctgtgcatgtctgtcactgcacttgcctcatgggatttgtatcagccaggatctagttaggagacggaagccacacagtagttggaacaggagtgcttcataggaagcgggatttcgtggactgaccaaatcccaccatgcccccgtgcttacggcttttctgtttacagaagcaaggttgaacagttgcacagagatcgtgtacatgcaaagctcaaaatatttacattacggctctttgtgaaaaagtttgctcacccctaatgtaaagaactattaacttgtggcagtttattatctattatcgacgaattattaactagtagctactataggtaaggagaactctaaagaatacgagaatagcagatagagggagtggccactccctccagggctggggcacagagtacctgaggaaggaataaatttggaactattctccccaccccctccaaagctgagattcgaatctcgatggaagatggctcactaggtagtggagaaagtcgctgagggccaccgctggctggagagtagggagccacccccggcatgccactgaagctcactaggaagctggctgggggtgtctgtgggactcggtggaaagccaccgaggaattgtctctaaaagtcgctgggaagctgcccgccagagcaccagtggaacttgctaggaggccgcccttggagcttagtgccactgtgtgtgccacatgactgccaggtcccactggagcaggcagggaggaaagcacgctggaatgatgaaggcaagccctttccaccgcccgcgtgcctccaccgccctctgctgatggtgctcaccaggtgccagcactggagaaacgcccacagggtcctgctccaggatcaccatgtgggcagtgaaggtgcatttgggatgcagaggcaatgcattgctaactggcaatgttgcaacaggttgtcttcagagctgcactgtaaattcctctgac

SEQ ID NO: 10082 - DNA, 2483 bp, artificial
  synthetic oligonucleotide
aaactactaatctacataaaatgtgactcatcagcaacacaggggtcaaatggcatcaccatgtttgtaactggaggatcacaactggaaataccagttaagtttaacgaaccttgaaaactaattgtcactaattgtgcacagacatcctccataatagctgatctcactagctgaagagcaattaaaaggcaaattgccaaggataaccatgatgtagagtctgaaagctactcctgaacattctttccccttattttttgataaaagacactcaagctttggcaagctatataccactatgaaagaagtcacaaagaattcaagctttgagctttgggaggactctgtggcacagggctctacttactgtaacagtcatagaggcagtggagacagatgctgtggaactaagatcaccttgaaagtctaggtatgattagaagatggtgtggaatttctaagtattagaatttctagcaacactccagttttcatcccaatgccatacctccacttccacagtttctggtgcccaaaattccaaaaacttttctaattgtctttggagtaaatgggttttcatctttttttctatgcctctctgaaaacacttaaatttacattctattgctctgctaagtaagctactaatcctctttcctcattgtggttcaaggttatacatctaaatatattcttgttttcttgatgttagagtttatgttactaagtctcattttcctttctgtttaggggcaattcccaagagacaaatacatctttgccatcttaaatgacaaatccacaaaattttcctttgaggagaagtgattgaacttgtctaagaaagacttctaggaggtttgcaaataaacgtgagagttgtattagtcaacagtgctggactgggccaccagcacaactactggagggtcaaccacttattaaccttaagagttctagacttgatgtatcagatgtggtgcagaggtgcatctactatgaagctaaggaatattaatcttcagtgtctgtcagttgcacaggcccctttcaaggccctgagagagtcgttagaaacatgctaacatgattttatgcctttctttaatttgaaagctaaggtattttgacagcaattggttaagactattgttgctttccactctgacttcccctccatcatactatctcttctgccagacagcaatggaatgctagcaagcatatttgggatctagcaaagggcaaggtgagtattaagtggtttgcagttgcttccatgtagttaatttattgctaactgtcttggtatagaaatggcttccaggaatcctcctatttccaattgtgccagttcacttggtgtcttgacatgaaggtttatggcttgagaaatatgtaggtaaaggaggagaaacaaagtttgaaaggaactaagcaagatagtaatctgtggaaaaatcttcaaatcatcagatatgtaaaattataatttaaatttggttctcatctatgcctggaaaaaacaaaaggacttgcctgaaaggaccatactaataatgcagcttattcaattatgcatgtaccacacattttcgtttgcttttgatagaaattgggtgaaaagtaattcatcagaatccttgggttcacaggggacagagttgtaacagacaacacatacatatgtgtgaatttgcattatttatgtatcccaactatttataactaaaaaataaatttggtcaatcaaatatattacaaaacccttgttatatgaagcggtaatcaaagagtaggcagctaaaaagcataggataaagattagagatgagttaggtaataataaatatggtattttttctagatttggtagcatttaacaggtttctcagctttaaaaagtgtaaaatattgtaatgtcatttcttattgtaaatgagtatttattttcctacttaattttgtatttgtaactttgtattttttcttaaagaaaatcatataagcttcaggccccacaaaatctgcctcttcagtacttgttgatgtgtcatgattgaatggtgtattcaggagtcaagtattattttctgtgcttttgatacctacaggctttgtgagattatgtatgtgcatgtgtatatgtgcatacacatatgtgtgtgagcgtatgtgtgtcatgagtctgtgatggggtaacatagagtagagataggaattcagcctctaggtctgagacacaatgaactagattcagctgtgtaccaggtaatgtgcattaatgggaaagaaaatatgtttcataaggaaatatttagttaacactaaatttggtttacacgtctaatttatagaaaacaaatatgccttgtgggtggtttgttactcattggtaacttttctgtatcatagaacaactttgatgagaaaaagcattttcatcatttgggattctttgaataatttgtgatttt

SEQ ID NO: 10083 - DNA, 205 bp, artificial
  synthetic oligonucleotide
tgagcggtgtttctgagggcatcctttctctggatattctccaggagcctgggcttgtctctctgaaaattggagttgcagtagatctgaaacaaaatgaaacatgttagttgttctgggataaattattcctttcccacctctcaaaattatgattttgttttgcaatggagaaaagaatgctttaagtggcagcaagtgtggt

SEQ ID NO: 10084 - DNA, 1602 bp, artificial
  synthetic oligonucleotide
atggtcagagatgaataatttagtcagatatctagaatgatcagatacaaagggtgggggattatggttaaatggatttagaagaagtcttcctaaaattggatgatgtaaagacagaaaaggaaatctgaatgccaagggttagttggtgagaaggttcagaggagcctgactagagtttggtaaaggagagtcgtcagttgtcagaggtgaggtgtccacagggaggaccctggcaactaatgttcagtgtcaattactgtttgatgtcaagtgctgtcagagagaggtgacagttgcaaccaaaattcagtgggtaccagtttaggcagagtggaaaaagcattgctttagaacccaaagttttgtgtttgaggctgtgaactattaatgtgtccttgatcaagtcagtcacttaacctctctgggaggtctcaatttcttcatctataaaatgggatcaacaatattatcattgtgaaatccacccagtgttctctattaacaaatgcttactctccaggagaatggacttgccagagcacgattctgaaactttatcctaggttctttcccatttcagcccccttcagcctttctgccttacctaagagttggtggggggagagtcaacaggggtcagggattcaaagaaatcaatttgaagcactacagccagggaagggaatagaagacaggaaaaaactataccactagagaaatacttgtgaaggtcacaggtctactaaaagactgagatttcattggaagattatatagcaatttccccttaccacactttactaccacatcagcagagctccagtttaataatagtggattacagctgaaagagcaaaaagacacagaccctctctgaggagaagtatgtgggaaaatccaacgtcaacaagagagacaaaaacaaggacagtagaggaaattaaagcttctggtacctatagctacaacaaacattaaatacattctgacccctagattaacataaatcttccctgtaaagtcctgttatcttagttcctattaactgatataacatgtctagccttgaagaaaaaattacaaggcaagccaaaataaaatatatatagtctgaagagacaaaggaaacatcaaaatcagactcggatatgggaatttaaattcaataccagacagggaattgaaagtaactatgaaggccaggcgaggtggctcatgcctataatcctggcactctgggaagccgaggtggaaggatagcttgaggccaggagttcataaccaccctgggcaacatagcaagaccccgtctctacaaaaaaatttaaaaaatattaacagggcatggtggtacatgcctgtagtcctagattcttgggaagctgagacaggagggtcatttgaccccaggagtttgaggctgcagtgagctttgatcacaccactacattccagcctgggtaacagagtgagatcctgtctcaaaaaaaataaagtaacaatgattaatatgttaagggctttagtggaaaaagtagacatcaagaccacatgggtaatgtaagcagagaagtggaaacttaggatgaatcaaaagga

SEQ ID NO: 10085 - DNA, 4370 bp, artificial
  synthetic oligonucleotide
caagcagagcagggcaggtgcgcccccggggtgggcagcgcagcaggagcaggtgttgctgaggaaaggtaggaaggaagtccggtatgggggaagggaggagatcatcaaataaggaggatttcccaaaccgcgacttgctgtttccaacgtgcaagttcccaagttcagtttgagaagtgaagggccgctaggtgtaggggagtctggaatgggaacgttagggaaatgcctccccgaggcgcattctcctacccattctcctctttcttcccccccccccactccccttcctcttcctgtccctattcgtcttccttcagctttgattaatatgcatgtctatgctccgtagtgcgggccaccgcctcccgttcgacccctggcactgggagactgagctgtagcgaccaaaggcttgggatggggaggctgagcgctcagagcgcggagtctgaggacccctcgccgcgccctgtatcccacccccctggctggagagagcgcctcagtgacccagactccgagatcccgctcggtctgcgttgcagtggacagacccaggagcttggagcgcgaaatgaaacgcgctaaattgtacctgtgcgtggccgttcccgccgccgccgcaggtctatcccggggccgaagccggcgcccgccttctcggggaattctccggagggggagtgcgaggggaaccacggtgactgcctgctagctcacggctggcgcgcacacgcacacgcccaactttgccaagccgtcggcgccccgcgggctcccccgcgccccctgcggctcaacacgctcggagacctgtatctctcctgctctgagataaggttccctccactctcacaccttcgcatgtaggggaggagagggcggagtgaggcagagaagggggttaatgctactgactccctggccagcctttctcaaacactctacgcccgcaggggcgcccgcgccagccacgccgcaccaggtcccccagacctgctggtgacgacagagagaggaggaggaagagaaggcagggcgaagaaccgggagccggggagccccggagctcgggagcccgggagcccaggcgacggacagttccatcgactgaccgtcattatcagcacttttattactaaaggactgggtgggaggttggggggtgtgcaacagagctggccagccccaatccactctggagcgaccctaaattagagccacagagaaagattctccacggataccttttgagtggacgtgctccagacacacacccggaccccgtggtcccgccgaagctgcagtgttgggggtattttaaacggttcttatttggaaggaggcgtgatttccacgttcgagcgtcttcgctccccaccccctctcggcaccagccagtgcgcgccaccacctgagcctggcgagagccgggacgcacgcagtcttcagcctgctcctttaagcctctggagagactcggctctgagcgggtccgcccgacacccgccccctccccccactcctgagaactctttactttttgtttggaaaatcggggccatttctttatttatctctgggtcttcccggaggagggcagagaaggggagagcgagcttggcgggccggaccgggggaggggagcgaagggaggggaggggactgggtgtagcctggaattctccgtcctcgtgttcctgggcgggcgcgcagagtctcctggcgatagcgccgtcgccgctccccgcgccaccccgtcgttggccttgggggtcgggtgagtggggtcatgacgagccgcgggggctgccccgggccccgcccgcgctgagaggggacgcggccgcgcggcgcggagcccccctggcggggaggccgcggggggtggggagggcgcacgcggtagggcggagtgggggcggcgcagaggccgccaagctggggggctctccgggagggcgcggccgcgggcaggagggcgtgtctccggctcgaggggaccctcccgaggcgcggcgcgggactccccgatggtggtgccgcggctccgggagagctcagggtctcgccgccgccgccgtcgccgccgccgcgggcgccgctgccgccgccgccgccgccgccgccgccgccgcccgaacccgcgccgagcgtgcgcctcgccctcctcccgcgcccgctctgctctaggatgctgcggcaggttctgcacaggggcttgaggacgtgtttctcccggctcggccacttcattgccagtcaccctgtcttcttcgcctcggcgccggtgctcatctccatcctgctcggcgccagcttcagccgctaccaggtcgaggagagcgtggagcacctgctggcgccccagcacagcctggccaagatcgagcgcaacctcgttaacagcctcttcccggtcaaccgctccaagcaccgtctctactcggacctgcagacccccgggcgctacggccgggtcatcgtcacctccttccagaaagccaacatgctggaccagcatcacaccgacctgatcttaaaggtgagaggggacgggtgcgggcagactccgccagcgccgcggccgcggtcgggctggctctgcgctggggtcccggctgagagcgccacctctcctagcccaggcagctgccgcagggactctcctgcaccgcgcgccccagggcggccgactggagcctcccagcctcctggacaaggagcgtcggggtccgggtccggccctgcccgcgtcgcctctaccgccaccccgcagctgctgcaacagttggggcggcggcggccacagtgctgtggtcggtgcgcttgttttggtcgcagtgggcttgggggtggggaggctttggggtaactgggccagcaaggagcagaacgagagaagacattctggaaagtcctactacttgagaacaaaatactatgcttggaggggattccgagatacccctccctgtcctcagttttgtttctccctttttctggccccccggagtgtttggggaacggttgttggtgtgggatgttgggaaaggacaaaagaatgtgaggcgggatggtgatgaagatgcctcccacccacccagaaagaagtgtggtctctggcgaggacagggggctgccctgctgctctcttctccggagcgaggtagccatctctatcttctagggtatgaaattatgtttgtaattcgcagttccttcgtctttcacagtagctcctcaagaaatgccaaaactttgggaaaagagggaaccgatcaatccacttttatttgggtgcatctgagcatgggggtgaggggcagagcccgaagggtgagaacagaagccaggctgtgtgaccccgagaagagcacaggaaaccgagcagctggttagagggtgacactcgcagaaaccggttgtgccatcagcttgaggtgggaatttgatgtggaaagtgaggttaatggtggtaactttcaggaacttcctaagaaaagcagaggagtgaggactagagatggaaaagtggagacctcgggagagaaaagtaaaaataggtgagaatgttccatctgaatccctgatggggactgtggggcttgtttacttaaggttctcctttggggagggcagacaagaaccagtcccagctgggactctggtgcagagggatggaaggtgatcgttttgtgtgagtctctagtccagatctggtactagaggctggttagatttctagtctacttatcccaaggggagtctgccgggaaacctggggaactctttcctcttcttttcctctacaggtaatagtttatccctagagacaagctaattttcattattttcctatgtccgtttgttgacatgttatcaattagcaattagtaatgaggggaatctgactaggggctcaatggaattaggatcttcccacatggagtggctcatgatatttttaatggcacacatcacacatttactcatcacagaaccttaataacattaatcccgagatgtttgtttttctcatgattagacttccagcatcaaagtggttttcttttttctctcaatactttagtgactatattttgggacacagataaatactgctccaaaagctttcccacgaaaacacatagtagattcatcatgggcataaggaaactgtaatttaaccagttctgacagttggaaatgccccgtcttttgattgatgatctactaaatgatatttctctttttgtgttttttcaaggtgacgtttccattgcctttccccccccacccacaaaccatcacaccactgtgacaggcagtcaccagttacagtcactctcaaggttaatgag

SEQ ID NO: 10086 - DNA, 1138 bp, artificial
  synthetic oligonucleotide
aatctgaaattcaggatccctaaacaaatagcttctcatatctatctaagtaatacactggtctaatccaatacactttctagacaatctcactaattcttattaggatagtatggggattttcaagtaacattttaagatattttttaaatgatttttacaagaaagagaatttaaagatatatcaagaatgagattgcaaaggtttgtgaaattaacatctagtaataagtagagaaaaatttagaatatataatgatataacagcaaaaacatagctagtgggaatgtatgatggttcaggtacttttgaaaacagtttggcagtttcttaagatgttaagcatggagttatgaaatgacccagcaattccactcctaggtatatatccaaaagaaatgtggacttatgtccacataaaatgttattcacaaatgttcataccagcatcatttataataggactaaaaatacgtcattaaaatggtctcatatttatagtgccctggcaacggggcaatgaaagaatgagtgtctaatactataaaatgttggtcctattttcttcaatgtgattgctaactgtgtaaattaaagcaagcaagcttgtgtgtgtgtgtgtgtgtgtgtgtgtgtgtgtgtgtgtttcctaacagaagtataagatgccatcaggtaataataggggccttgtgtatggagtgcatggtgtttggtcaccttcagggatggattctagcaggtcatcagaatgaaaatccccaatccccagctctgcattataaagataaaaagaattgagatgaaccaaagacaggaggttttccagagactctcacccacgaaagccaatcatttcctccccctcctccttcttcttcttccagatttacctcctttccttcttcagatgaagttgtctcacgcaagcaactggtcctaaaatctaactcaattatttgagaaggaaggacatttattaacccacatgaatctctacactgtggatttcatctaatggatcgtagcctctaccttgtggactctccagaccattttccaggatgctggtccccattgtccagctctcattcccaaaatatcataatcaccctctatttgtcatagtctagagct

SEQ ID NO: 10087 - DNA, 1128 bp, artificial
  synthetic oligonucleotide
gaaatctgacttttaaagaagagctccaggggaactgatacagctggtctttgattcaccctttcagaagcacagttccacacagccattggctggcaacaagttctgctcctaaactttaatccccagtttccaaacattatgtttataagaagtattggtagtaaccatgaggctagtttaattttcttttagtcctttatgaggccccagttctttttaaattaaccgtggcagaacccattggtcttcagtgtcaacataattcagaaaggaaacaagaggtgcacaaggaggaatgagatgtttaaaaatataattaaaaaataatagcaggaacatttacttagtacgtactaggtgtcagattctaagcgtttccatgtgtgaacacaaccacttataacaacgctgggagtacatactattattataaccagccccatgataccgatgagaagacaagcacagaaaggttaagcaacttccctgaagttacgcagtagcaagtggaaagcttgtctcaaaacaatgaaaatggaaaaggaacaaatgaaatgggaaacgggaattctcccccaaaggtatgctgtcttcagtcaatgtcatgttgtctctgtttcggtgctggtatttcttatttaatgtcacatttcaaattcataagagcacttttaaataaaatgttttctgctcagaaacaacttcaaagaaaatgagtgcaataaaacaaagacataggtcaggggcaaggtacccaacatgaaaagaaatagaaaattgcacctccccactttaagtaatttagcttcaaatgagccaaagtctcttgaaatcagatatcgtgtaggagatcccattccacactccaggaaaaaaccatagcaaacagtttaactgccacacatcagactacatccagtgcaatggtgtggtgttagtccacagcagttgttcccaaaatgaggagtgaggcagagtcaggactgcctggagagctgatggacagagaggtccagtttgggtaaagtggagcagggcctgggcctcagtatcttacaagttcctctttagtgattcatatgctcaccaaagtgagaaccactagtctggagggttctgggtcca

SEQ ID NO: 10088 - DNA, 2126 bp, artificial
  synthetic oligonucleotide
ttttatactggatcatgtgtgggctagagtagccagaattctatttttctggaagataaaggcagaaaattctgtcactgcattcattccaatctccaggatcagagagtacgagagttcttcattcatcttgttagtcactcaacccacagtactaactgagcacccactatggattctttatggattgctgaagtaggtgttgggagacggtgatgatgatggagaaatcaggaatgttttcctgagtaaattctcatctcaatggacagacaggcccaacaaacccccaaagcttgtcccagaaaaatacacaagtactgtgagcgatttattaattcattctcattcagctcctaactcactcttccatgcgctggttcgtgatgtggaggcagggcttcttcaatccacatttctgcttttctagttggagccctattaggctctaagggggctgcagagctggaggaagcaagagcgagttgcttctttctgtctgctccctctgaggatttctccaccaacacttcacttctgcagtggcagtgtctcccgtgacagcagctgaatgcagtttacagtttttccaagccgtgtgggatcagctttattcataaactccagaaccaaccatcctcagaggtctgggcttcaactccatggagactcctctgaccatctaagtttcaagagtattaagaattccaacctcttctttttgttttcctaggcctcaggggtgaagttgctttctgtagtttttccctccctgattccttagtgtgttctttcagtctttttagtttcttagttaacagtgctataccttgttaacaattctttttaccgaggtacatatttttcctgttaaaataactgaagagatttctgcctcctcactggaaattgagtgatacaaaatcccaagttactcagcctttccaatgcaacaggtttttggaaaccctctgaacagtcagattgctataaaagcccactgagtactcacacaggtgaattttccccttccctgtccaaatgcaacatcctcagcaatctttgaataagtacacaaagtcatgatatttaaaatatgtacagtaacatatagcatccagtgatgtacaaaaactcaaaactatgtatacaaatctgggacttcatgacagtgagtccctacttgacgcttctgtggctcacagtggacaaagaagccttacaacctgtctttaataagaatctgcttggccaggcgcagtggctcacgacggtaatcccagcactttgggaggctgaggtgggtggatcacctgaactcgggagttggagaccagcctgaccaagatggagaaaccccacctctactaaaaatacaaaattagctgggtgtggtggtgcaagcctgtaatcccagctacttgggaggctgaggcacaagaatctcttgaacccaggaggcggaggttgcggtgagccaagatcgcgccattgcactccagcctgggcaaaaagagtgaaaccccatctcaataaaaaagaatatgcttgatggttgtactaggagcctcctggaaatgcggctataccctggctcgtactggcaggcccgttctctattcctgtgtttaggcttcactactgggtttactccatctgatttttgggtttggtgtacaaaaagcccctgccagcttcctttcctgaaaagctagagcctggtgtttctacctggtcaggctctgcctccaccggatcaacttccccggaaaaacttgcaacccagaaattcctgctgccaagatctcagccactgcttaaatcatctggatgacaatgacacacccaactcttaagataaatttactacaacctaaaacactgactatatagctcagtcaatgcttctagagtctccaggtttcagcttaagcctctgttcttccctgctcaaagacagagttggtcaagtgagtctaccaactaagaccacacagtttacagcaatacagtccttcactcaattccctttgaacacaggctcatatttggaaccactgggatctgcaatgtgtggccatgcaaaaatcttccatgtataatccacgttatgtaaagattgtttt

SEQ ID NO: 10089 - DNA, 1309 bp, artificial
  synthetic oligonucleotide
gattggagaaaatattttcatataaagtttaccctctatgaactttcaataagaattgactcctttgaaaaatccttacctactcccatgattctggtacggaccagggttcaataactcttctaagaacctataagcctttctggtctctggacttactatatttttagctcttttattatctccttggccatgttgtatgtataaagttctaataatgttttaaatgaaggccatataccaatatagtagagttctagactgacaaagttggctttgaggaaaaaaggcgaatcacaaagtgcttttaagcatgaattgagcacaagaggagagcatgacagtaaagaaaaacattttactattatccaagtaagtctgaaatatgtcttgtaaagcagttggtggagctaccaaaaatgaattaaatgagtttatttgtatggcacttttttttggtttttttgagatggagtctcactctgtcgtccagactggagtacagttgagtgcagactggatcttgcctcactgcaacctccgcctcccgggttcaagcaattctcccgcctcagtcttccgagtagctgggactacaggcgcccaccaccacgcctggctaattcttgtatttttagtagagacaaggtttcaccatgcttgccaggctggcctggaactcctaacctcaagtgatccacccactttggcctcccaaagtgttgggattacaggtgagggcctgtgcattttaacttaagttctggagtgcgttgtgtgacagagtattcatcccaggggttggcgaaagaactgagatgaagaaggccagatagtagtttgtctaaaatattaatttccaagctaagactcatagtgaaatatcagatactatggcagtgagacagagatgcatgaaggggtttaacatgtttttgtgagggattttgagtgatattggtgccataaaaaaaaactgctttggtgcccagataacaaaatgtgaaacagaatgggtaatccccattctcctcatctcagtttctagaggactctcaggaacatgaaaccttcttcacaccttaaggtttccttgtggtgaatcctgagtgaaaacactcttggcccagatattaaaattcttgtagaaagcactgaaaacaatgacagtgatgagatgccgccttcaagtaactttacggacaacctctaatattaggaaagaaggtagtcatggaaagatgaggggaaacaaagacatactcccaaatatatagttcctgagttgccactgaagtcctgaggacct

SEQ ID NO: 10090 - DNA, 1614 bp, artificial
  synthetic oligonucleotide
tacttgcacagaagaattaatggacatttgaagacttctgtagtaacacttttaatttagtccagctatctataccaaagcaatttggagataatttcagaaattttattcaaataaatgaaggttcaactggttatcatttgtgtgataaatcccatcaccagaatgctactcatttcgacttgcttccttaataatcacgtatcactttattaatattcattcattcatttgttacatgctggggagaataaaatgaattctcctcattttaaatagaatgagattgaagtccaaaggaaaataaattgtatacaggtttcattcatttatatattcattcagtccacatttcttcaattcttactaaagccaggccctatcacgggtaccgataatagatgtcaaaggagttacagtctactgtgtaagagagacatataaagaaataattacaatacaatgtgtacaggcatttccaaattaggcagaaatatacccagtattaaaatatttggtatcccagtccacagtatcactctttttgttcaagagtctttgtgctcctttgtcaccatgttctttcatcttcccaaccactttccacagtgatatttctaaagctcacgtcttataatgctctccactgatggaaacactaacattactttcccaaccctaggaaaagggtatgttaggttacacacaagacccaatctcactgtttgttcaatcatattcctttaatatctctcttgctgttaaccagcatattcagcatttaaaccatacaaaaaaacctatcaattccctctaactccccaaatactatatttctgtgactttgaacatacttccgatcacctagaatgtacctcttgtacctacattgaagactcttttttaactgttaccttctgtttacgtacctttatgtaacctctaaggagagaagtcaccacttctttgtcctctgattatatcttgttttaccccatcataggccttgtcatactctattccatttatttgtttacatgcctgtctcctatcaagttatgacctccttgaaatcatgggtaatagcttatctttttatacacagtgcctaaaaatttgctgagatacgatggatgattttttaaaaaattgtcagacaggctgggtgccgtggctcacgcctgtaatcccagcactttgggaggcccaggtgggcgtatcacctgaggttaggagttcaagaccagcctggccaacatgatgaaaccccatctatactaaaaatacaaaaataagctgggtgtggtagcctgtgcctgtagttgggaggctgaggcaggagaatcgcttgaaaccgggaggcagaggttgcagtgagccgaaatcgcaccactgcactttagcatgggcgaaagagcaagactctgtctcaaaaaaaaaaaaaaaaaaaaaaattgtcaaacgatttcagttcccaacaggagtactatgagatagggaatgaggtaaattgactttctgttttcctcccaatctaaagcagtggattgcaaaatgtggtttctggacttgtaatataaatatcatctgagaatctgttagaaagcactatct

SEQ ID NO: 10091 - DNA, 2408 bp, artificial
  synthetic oligonucleotide
tgtaaaatgagctggttcaagatggagcacaacaaccaagaggcatactctaaagaaagagaggtggggaagggagaaaaaaagaaagggaaggagaagaaagaaaatgagaaggaaagatgagtaatgagaggaagggaaagagaaaaaaacagattcgatactctgaactcttacaatttgcaagcattatctcattcaatgctaaaacaaccctcgagctaggtgctattatatttgtcattatttagttggaaagactaatcctcagaggaatccacttgttcaaagttgccagattcataagaagatatttgaatcttggtcagggtttctagctggctctgtgactttaataacttcagtatcctccctttccgacttagttgttgtcttctcaatcagagtgggaattattactaactggacttctccatttgtattacacgtgtcatgcacagaaaaatgcaagaggtatgtgttagctgtcattggttctagttcttcactgttcccttcctgtatccatgccctttgacatgtgactttgcaactcttccctctatagagttgtgtattagtccattctcacactgctatgaagaatacctgagactgggtaatttataaaggaagaaggtttaattgactcacagttccgcatggctggggaggcctcaggaaacttacaatcatggcagaaggcaaagcaggcactttcttcacaaggcggcagaaggaggtgagtgcaagcaggggaaatgccagacgtttttaaactattagatctcatgagactctcactttcatgagaacagcatgggggaaacctcccccatgatttaattatctccacctggtctctcccttgacacgtgggaattatggggattacaattcaagatgagatttgggtggggacacaaagcctaacaatatcaagttgtattgtatttcctcaactcttgagtttgaatttggccatatgatttgttttggccaacagaatgagatgaaaatgatggtgtgccagttcccagtctaggcaaaagtcttttgtgcctccaccacgccataaagaggtcagaccctcagtgatccaaggaagagaatgagaagtatttggagccaactcacagacctgtagtgtgaagcagagctacccccagccacatctttgatcaaagtccagctgacctgttgaccaatctcagacacgtgagattgcccagctgagttcagtaagccacccagtccaaccacagatgtgtgatttgtgagcaagcccagctggagtcagtagaactgcagatgtataagcgaatcaaatactatatctatctatctatctatctatctatctatctatctatctatctctctctctctctctctctctctctctctctctctctctctctctctccccctgagattttgtgattcttatgtctagtagctcatattacaggataagagagagctaatatcactgtacttttgaatatgtggacacataaaagcacgcaagggcagtctacgtgtgctacagtcaaatacctgtacaacatgactgctgggaggaaaaaacaccctgttgtttatctctcctggtcacacaatgtcaagtaatcctgagccacagggatatttctttcctccatggtaactgatctgtagcacactacttgttaaaaaggacatcgagtcagagggagaagacaaagaactttacagtcataaggttgatctgtggctccaggaatgttattctgaaatatcctatagcctgaaggtgcataaatagccagtgggtcctcccttctttataaagatatcacatattgctgatctttgcttctactgagcactattcttaacagctattcataacctttagggactagacactaagaacagtggtgactctcaaggttaggtaagtaggaaaggaagatgaggttggaaagagtaataaagggagacagtttttataatacacatgcctatcttgccagaattgctggtgggaagtcatatgcatattttataaaatcacccaacatactctggtacttatgaggttccagttgagaaagacttcactaagagcagtcttttcaactttttcagtctatggcccatctttcctatgaaatcccactttccacaatgaaaaagaattctatgattaccaagaattatagagaagcaaaataaataacttgtagtaaaaattttttgttggcaatgtatatgaatctcattattaactttcagaaatatgagtctttaaacaagattctgagagtccttgtacatttttgaagtttaggaatccaacttcccaagaaatgaaggaacaatgaattcatatttgaacttcaatgcatatacatcttaacttc

SEQ ID NO: 10092 - DNA, 351 bp, artificial
  synthetic oligonucleotide
atacaaaaaaaaaatttctagtgtctgtcatcagactatcaattctatctcactttcttcattcaactgataatattaattcactgaagtagtatataagactccaatgtagaaagctacaactgattacctggaataaaactggaatatcagatcaaatacttattgcattttcatttgtctattggataactttacagctttatttgtctcctactttgaagataactttggctcaaatgcaaagaggtgccaacattggtgaatatctagcaatgtctttattcatggctctgcttcctgactgacatcctctgctttctcattttcaggtttaagatgtttttcttt

SEQ ID NO: 10093 - DNA, 1669 bp, artificial
  synthetic oligonucleotide
taccccttcaacagctggaagacatttgtgctgttcccagttttggccgttatgcttaaatctgctataaacattcatgtacagatttttgtgtgaacatcagtttttgtttctctcaagtagatatcaaggagtgtgattactggtacatatggtaggtacgtgtttaacttcattggaaactgtcaaactcgtttccaaaggggctgcaccagtttccattcccactagcaatatatgagagttctggtctctctgtgtccttgccactgtcatttggttactctgcaatttcagctctacagggggttcaggaaaagtcataaatttgaagtgactttgattattttttcatcctaagaatgggaggaatgctcttttaaactctacatcacaactagaagccagaagtggaaaaactttgattttaagtttaaggaggtaacacaagtttaactgggaaattaaggtcaaaaggatatacttacattattctggaataaacagagctgcattgtatagagacacaatgtacagggagattaatggagataaacacatcactttctttgagtagtctcctttaatttttttcatgccaagtgactagctctcttccagatgttcccagacaactttgcctataatttacggtgctgatattacactgctttatcattattagttaatcacaggttgtatatttgaattcttatgagatcatagagattatgtaaatagatcttgccaaacataacacaacgggaggagtggagtcagtgcatgctatgccctactttaaggtagttaaaattaaaactcatatgtgtgtgtgaaatggagcttatggtccccaattcaatctgtgtggtgtgtggctgtagattctgtaagcagtggtcagcatagtgccagcagcaacacctagcaggtgtttgtttgacatttattgagtgaatgagtgaatgtcacagaatctggcaggagatccaaagcaataacaattagattaaaacagattgttttcttttcttataatctttgggaaccccagtggctttttttaatatcttatggaacttcttgtcccatcacaggttttgacagtttctacatctacatgtcatgaggaaccaaaattgaaataaaattaaaataattgaaataataaaggatgaggctcaatttcctaaagtagcacatggactatttttacatcagttgttgagtcaaatgatgacataggaagatttacttttttatttttatttttattttttgagatggagtctcactctgtcgcccaggctggagtgcactggtgccaacttggcccactgcaagctccgcctcccaggttcacaccattctcctgcctcagcctcccaagtagctgggactacaggcgcccaccaccacgcctagctaatttttttgtatttttagtagagacggggtttcaccacgttagccaggatggtctcgatctcctgacctcgtgatctgcccacctcagccttccaaagtgctgggattacaagcatgagccaccacgcctggccgaatatttacttttttgccatgtaatatacctagtttggtttggtgaatggcagagagatatttccttaagattaaaaattacctaagcaccactcatgttcatctg

SEQ ID NO: 10094 - DNA, 1403 bp, artificial
  synthetic oligonucleotide
gccacctaacttatcatgatttgggggagtttcacgagaatccagttttgataaaacaattgtttttttcctccccaagtgactatacatttaaatagctaaaacatctgttcagcaacatagtaaaacatatatactcggaacgcttgagagaagagcctgccaaacagggactttgctgagggagagcaccaagataaagcaacactgtttgttttgtctagtcagggggaaagccaaggcaaccaatattttggtttttataattttcatttgtgaagaattatttgagaaagggtggcgaggggagatttcctgacggcagtttcttaagctgtccattagtagaagagcaagaaagccttggatgtcaacgcctcgctcttgagaccagccaccaaaccacgaaaagtgactttcttctcgtgtgctctctacggcccttctgatggaagcagaaacagggagcagcgtggagactggaaagaaggccaacagaggcactcgaattgccctggtcgtgtttgtcggtggcaccctagttctgggcacgatcctctttctaggtaagtggagtgcaggaggccgggggaactgggtgtgtgtcgagaagtttccttgtgctttattgtagcaaaacttgtcataacacaggtatagggctgtttgcctgcgttcataggtggtgtatctttagtttctatcaaatatgcaaatgataaagaaggcttttttaaggagcctaaataaataaatacacccaagtaccaaatgtatagtccagaaggcaaagtgggtgtaagtggcttcgagtggctggctgattctgttgcattgggtggaaaattttttatgtggtacatttagcaaaatgagtgtttgtgaattcatagtcacatagtttcatttatattttgaggaaagactttacattgtgatgaaaaccatgctggagtgtctttccatttgacttttattaatgtttgcttgaacgaatcatgaaatttaattcacaaaacacaaatcagtcctttaaagtgtgcttttaatgatattcttcaattcctttcttatccagtgactctggtgagatgcaatttgatttacaaattaatatgaaggaaaacagaggttttcccccaagatttgaaagatattgtgattcagttattttaatgactgttggtgagaatgatgtacccagagagtatataggatgatagaagtgtattcccatgaaaaagaatcaaatatcttggaaaggagtgagggattttctaaaattctaggctttctgaacccttgactattaccgttttaatttttctcatacaacccataatacttcattaacttgaacgttacataggaacgaggagattctaggtgcagtttgaaatgta

SEQ ID NO: 10095 - DNA, 1029 bp, artificial
  synthetic oligonucleotide
gggggtggcttattatctctgataggagccacactatcccattactatacttggaaatgtttctgtgttccgtctcattgtgattgcttgttcaagtgtgctgcccagagataaatccatactcaattctttttacagctgtcaaaccagattctttgtagaattatgttgtcttttgattgaatgcttttctcccccgtaagagcaagaagggggagaaactttcagtttttattgtttaatacctatgtatgtcattttatatattgaatcttcattcatccttcttaaagtaaaactacattgaaattttataaaatcagttatctgccccagtatttcacaagctttaagaactgagggaaaactgggtcaaaatgtttttttaaacaaaatatatgtacccttctacaatgttaggtaatatggaggaaggttcttttaaaataaaaattactatgtaaaaatactctgcctcccttaaatcctaaaactaaaatctgaatccctttttccttcaccttctttctagaaccaaaaaactaataatacattaggccacctgataccttaactactataattcacatctgttaggcctcgcattttctaccccaccctctactctatgaaattacatctggctttagatgcagtattgccttgaggaaaaaaagaatacgataactactatataattcctcagggttctttcctggcctatgattttctgaaatagacttatgctgtttaaatgtgtccttgtttttacaactccatttagttattctaaatgatcatatgattttgtgccttcctcaagccaaatcattctcagttaagattccctatcttgcttccattttgttcataacccacaaagcagtttctcctttttacagtcttccatcccccatccctcaaaatcctctaggtgttgaatatattcagcgatgggccaacagagaatttaaaagctgttatttaaagtgatttttgtatttttagattatagttctaacttagata

SEQ ID NO: 10096 - DNA, 2319 bp, artificial
  synthetic oligonucleotide
tctatttttcaagttaatatatgtaaaactgtattaatatgtccaaatccatttgacttgcatatatgtttattttaaaagatacttgatgatcattacagttcagaggtcaatgtttgcctcattatctaagtcatagatgagtagatcagactttcccattacattattttttttcactgcattataatttgctttgctccccctagagtttcctattgccatgtcttccctaaagatccttcttcaaagtgtaagggtgtgggaaccctgaaaaagaggcctgtattttcagccagtaggttttcttctctgtatatgtgagtgaaatttaatacctcttctttagtccctcatatttcacattaagcaccaaaaataccctagtttcttgttgatccatgcactcggtttgagggaatatctctagcacatgcttttataatctattcccctgttatattcttttccacatgcacaaactgaagtggagagttaaggtaatggcagtacccagttaagaatcattttcatataaaatgctaaaataattgaaagaccaacttttttgttacatatacattgggtgtaggtattcaaacctagagaaaaaggactttaattttaaaaattacgtcatgtcattccttaccctgtaagtgccttactcttcaggcactatttctagatccattccaaattctgagaaatgtgcctcatcagatcactaattatttttatttgtcatcgcttattcagctatgctgcatgtatttgtaaatttactttttcaaaatgctgaaatctgaaaaagaggaaatcagcattatataagtgctgtatatattgacatttttctaaatttgtcatttcagctgaatttggttcaactaaaagctattggccaaagtcaaccatccgtagataaataatactattggttgggggaggggagactgcttctaacatttttgaaaattacttcagttgttgcctttttacagagcagaggaaagagtattggtgttaattaaatattttctagtggctaaaacaaggtcttaggagtgaggacaatgggtaagtcctctaacataccgcaccactaccgaatctccctgatgaagaagacctgaaattgaaccattacagaattcttcattgatcttaaagttctggcttatgctaaaatgcaaagacacctgaaagcataatgaaaactagtcaaaatttttatagattatagattttggtacagaagatggacaaaatctcaaggtaccaggatctggagggtgaaggtacactgcctccagagcaggaaaagttaaagaaatagtgagatgaaaagatcttgaaggcagtttttcataacatcatgactttatctgaggtcaccttttcttcatagtacctaaggagctacctcagatgtgaaacgtaactgctaaatgtagtaacaatcctctacatagacaggagtgccatttttattgtattcttccttctggtaggtgcagaaatacactggagccaaaatgcccatcagctcatccaaatacaaatcttcagcattcaaacttgaaaaaatggaaatgaggttatttcttttttcatagggtgtaccagtagtctaccaagaattatttagaatagaggatacaaaaggaaataatctgtggcgtttatttaactcaatatgtctatttaacctttttgaaaatactatcccaggcttaatttacctgatagcatttatagattaaaatataggaaagtttgtagtagtatggaggtaggcactgatacatgtatctttttaataaacaagtttatcctaacataaggaataatgattttttaaacttataaggaatcgtttttatctatacaaataaaacaaccttatctatcctaagatagaagattgtcaaagaataccacgttttaattaaagtagtagttttatttctaaaaatactaaaagcatagtgacttccaatattgattaactacaatgatgaattttgatttggattttcttttgaaattcattgatgaaattatagccaaataaacagaagcatacaattcaacttcatgctcacagagcaatttcattagtacatttcattaaattggcagctcttttgatgaattcctgatttctcaaatattttgtgatagaacgtaaggacttaaccatcccttagtcaaatactacaagcaaatttaataatatctggaagctttaattctgttgtcattttcacccatttgtaaaaacagagatgtctcatctgagatagaatctcttat

SEQ ID NO: 10097 - DNA, 867 bp, artificial
  synthetic oligonucleotide
tattgagtacacctgaataataaatttatattctctcttgtcaatcatcaaggtataatgcatagagcagattttgtttctccatcaccaccttttagtgttttaaatagtagtgttgcctttctggttctgcagttttggtggaaattttccatccataacaaacagtcctgattaggtaattcataaaatttattattttctaattggaatattgctattcatacactaggttcatgtattttgttggtttatttgtttgtttagaagagtaactcatgcttattgccaaaagtttaggaaataaaagtataaagaagaaagtatgtattgcaagtccttactccctttaatctaaccaccattaatggtgttttctatatttatgtacattctttaacaaaagtggaataaaattatgtttgctattttggaacttacttttttcacacaatttttatatcccttactaatggatacatttacataatgtacaggttttggttgatttaaacaatactgtgacacatatgttgcacatttatttttgtgcttttatccaatcatttccttatggtagtggaagtagaatttgggagccaaagatatatactatacagttttgatgtatatttctttgctcttgtttaaaacattgttaatgtcatgtgaataataaaaggctgatttaaaaatagtaaaattagatacccaaattttctgccattaaataacatcagctgtaaaattaaaatccacccaaatgaactttcttgtcagaaaccaattctactttctgatagaaaagcaattctgttttttggaattgttacttaaaaagagcatgtagaaagtgtgaaagaatag

SEQ ID NO: 10098 - DNA, 3312 bp, artificial
  synthetic oligonucleotide
tctaaaataggtactttagaggagttggcccaaaacctgaaacagagccctttaaaatggtacttggggcagaacctgtctcaggatcaccacaaccagcagctggcaggtgacagcctcaacgcctgacttcccaggacccgctcatcacccggggaagatccgacagcactagccctcctgcctcatcatcgctgcgcttctggcaggcggagccccgttctcgtccacggcagtccacacctccgtctctgcaggcgtacgcgggtctcgggaatcacctccggagcccactcagcagcggggagggcgagggcgaaagcgagagccaggaaagcccgggctctcgctgtaagccccgcgctcagtggtgtccccctcccctcggtggtggggccgcggatacctcctcagccgcctcagctgtcggagttcaactggtgggcggcccgtcccgccgtggccgccaccgccgggtcccctcagaggcctcacaaagccatgctccagccgcccgcacctgattgaccgaccccgggctctggctctgcctcgcgccgccaccgcctccgccgccgcgcacgcgcacttcgcgcgcctctgttcccggacggcccccagagcgggaacgccaggctgcgagctgctggcacctgtctgcctgccagacagaccctgggctccggcctcgtgccggcacgcgcacgcgcacgcgcctcgcgcgcctgccgtcggccctgggggcgggaccgcgcggcagcgagcgggcggggggctcgtggcgcgcgcgccccgcacccgagggctgcggagagatattttgggtggcaggaggcccctcgtcatttccgccgggcagctagtcgtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtaatgcccgctgcggggagggtgaggcggcactggggcgcggggcaccagtgcgaggttaggagggggcgcccgccgcgccagagcccgccaccgcggcttccactggcggatcgtcgtacgcgtcggggcgggggtcctccaggactggcaggggcctggggtccccggtctccttttgtctccagctagaggggcgcggagcggccagagagctagagggcagcgggcgccaccccgttggaggcaggaagtcgggaggcagaataccggcgcatcttgcgtactcccctctccccttactgcccccgggccaggaggacgtggcgacccttatctcccagctcagggtggactcccccaggacctgctcccctggtcgccctttcctggcccctttgttcctgggaaagctgacgccccctcggcggccgcccttgccaggtgccttccccagcgccaactctcccaagcaacttttagcccacataatggggtcaggacgcggccgcccccattcggagcctggcatccccccacacccagatttggctgaggatgcccagggtgggggtatgtgctactttgagggtgaggacatcatgcttcccctgggacagcatccttgctgctgtctctgggctgcctccagcgcatcccctcgcatcctttgccttctctgctttctccctttcaagccagtcgaggttttggacctcacggctttttattaagggctcaacgccagatgtaaggtgatgcgcattcaggtaccttcacatttcttccatcttgaaggttcccccttttgtccctggcgatttataataaccacagttatagacactcaccctcctaatcgcaaacgtgagctttttttctgatccctgggctttcctgtctcactacctccctctgttgtctgagttaaggggcttgtagaggactcccccacccaccaaccccttggatcctcaggcccaactcttccctaagattttgggaattgaagaggggatggatgggatggaatggaataaaggatgcgtggccacacttgggaaatgttagcgctttgctcgaggtcatacctgagcaaactctaggtagatcagtcagggaccaaaggcttattatcgctgaaaatgcccgttcctacgatgaaggagccccttcttgggcttacttaacagtcagactttctaagctccagataatttagaacgaaaggtgaggtgattgggagggattgagagtgacagggagaaactgattttttttgctcattcttttccccagcctttttggccgcttgcttattcttgtggatttttctttattttgctttccttttattcccttacttgcccctttattcctcatttactttgcttttcttttctaatatgtggaaactgctttgtaactgctaagcagtacaaatgtgagtgaattgaattaaacctaatacattatttatcgactgcacccctgtgtgcagtgcattgtgctaaggtgccatgggggatataaagatgactaagacaaagtcctgcagtggctcatctttgctgctgctttttctctttatgtatttgctattgaaattccaatatcttagattcccaccaattatcctcactctccaccttctccgtttctcagtgatggaagaaagagccagagtatatacaggaagcaacaatgcttaaaaccccgttctttgaatttgtctaaaaggttactttagtttgagtctgttgctgaaatattaaaagacaagctatcttggctccatgggagtctgattaccttcatagactacctttcgcaaattcccatgatgcctgtagtgagtgctgcatactcagtctccacctcccaccctcccagttatattcttgcagtttcccctctctccatagtt

SEQ ID NO: 10099 - DNA, 1293 bp, artificial
  synthetic oligonucleotide
aatggaatgcaacagaagtgttctgcatgtatgctttaagaggccttgcacatctccttttgctctcttacaacactgctgctgccatgtaaacaagctcaggctagcctgctggaagataacaagcatatggctctgttgccccaaacatctgataggacagccagccaatcccccagagcataaccaattagctgactgaaagttgattgtagagccagctaagaccagaaatgtccagttaagctcagtgtctgttgccaactcaaattttgagataaattaaaaattattgttttaagccattggggtaatttttatgctgaaaaagctgatacagtccctggcacagagttagcacccaatgatgatagctgctgtgattcataatagtattaactgagtgccaggtgaaatacctagagccaaatgagcctcacagttgtatactgcctggtataaacagtagtacctgtacaatgtttgtaagtttttaaagtcaattacaatattttaaaattgggagagtttacataaaatcagctaacccagctttccttctccaggcaacaactgcaagatctgagtagttgctgcccttgaaatggggaaatttctccttagatgttcagtttccccaactttctgtggtttctgaaacacaattattcactcaaaagtattgattctgtttcttatatgtagcaggcattgttctagggtctgaagatacagtgacaaaaaaagaaaacaaactttctactttcctatggagtttgcaagtgtgtgacagcgtggactgaggggggttgcacagaggctgggaaacagtccatatccttgcacaaattttttattttgctataggaagccagcaataaaatcattttttaattatttataaaaacaggacacttaaagaagaaagtcgaagaaaaacatttgctgaaccatagacggattgttgagaaggatattatggccccatctaagcttagagcagggtttctcagctaaggctattgatatttcagactagataattatttgttatgggggctgtcctgtgcattgtagaatatttagcagcatccttgacctccacctactagacgccagtagcacctctcagttgtgacaaccaaaactgtctctagacattgccaactgttccttatggggcaacattgtccctgtttgagaactaatgacatagagtgaaggagaaatacaatgggcaaaagctgtcaactgcactggttgggataaagctagcttctgtaacaaaggaac

SEQ ID NO: 10100 - DNA, 1246 bp, artificial
  synthetic oligonucleotide
acacacacacctatccattggtgtgaaaacaaagtgctggcagaacggtgcagtgagggaaaagaattggaaaggaactaagcccatgattggagaggaggaatgaaatcagggtaccagtctgtcttagagttgcagtactgattgatgtgaaggccttctccaacagagatggcctcagtctgttctagtgaccaatccaccttggagaaaaccctcatggttgctatctctgactccttcccatcttctcttacccacagtctttgtttcttgcagaatgaggatctgggctgatcttggatgaaattgcgtgaaaggctcagtttgctgtggctctgctttcatgcttacagtgccttctcctcccaggtccaaggagaaatttaggattccctgactcaccagagcatttctcgtcccttagtcttattcctgggaagcccctggtgctgtcctcagatcctctttttctaccattaaaactgcccagttctatcattagaaaaaacctgatagtgcaacttaccggaagctcttgacttcctgaacataactttctgtaataactaatggtaggtttaagttatatccttctcaggaatacttgcattttatcagtagacacttctaaaaaacagaatactaatgtagaatttcaggcagcatgtcacagtaggaagagcactagattagctatcagcaaatctgagttcttctttttgtgttttgaccaagttactttaggacttgagacaagtatcacttcctgtctgaaatggtcatgtaatatgtgttctaccctttccggaacatttcacatcatcccatatgtcagccactatgcagcccattcccagaccaactctaattattcaagtacctaaatgctcctgggctatgccatttttattcatgattacccctttctgggcaataaattctgcttctttgctctgtgtggggagctctgtgtagcctaagggccacatttaccatggtgtttggcttcttttctatgcagaagttatggtgctatgctacaatgccattggccactgcagggaaacattggtctccctgttgttatttatcagctgtgaccaagtgtcccaagtctcatctgacagagtctggggcatttctacccccatcttaccaaaggagcactattctttgtaccacaaagaatagtgactgattgaaaaataaaaataaaaataaaagttgacatactaggggaact

SEQ ID NO: 10101 - DNA, 1732 bp, artificial
  synthetic oligonucleotide
atctagataaaagggacttggattacgcaagagaaacagggctgctttttccttgtcattttttctttctatctatttgggtttttaaaaattgttataaaatatgcataacataaaatttaccatttacatgtttgagtgttcagtccagcgcacactcaaatacagttaaatacattcccactcatgtgcacccaccactgtgcatctatctccagagagagctttgtcaccttcccaaacagaaactctgtacccattaaacaccaactcccacttccccgcttccctgcttcccccaggttctggcaaccactcttctactttcttcccttatgaatctgattgtcctaggtgcctcatacgcgcagtttcatcattgttgtgtgggcataaaaatccctcctagcgctgtttgctgtgcacttgttgactgagggctggcctctaaatgcagacaggaccgatgggggcagatacgagggtgagggtgtctgtatagctgagcaaatgctgagcaggaacacacagcacgttaacaatatgtacacccacacgcatgctgctgggaatgagtgaagaggaagctgccatgttagaatggagtttgggccggagagtctctgcatttgttactcactggtggacggaggaagctgaattctaaaagccgtttaatgaaggaatggtgagggctgggcaaacatgattagtcacagagctccaggcctaggttatttattctctagagaagcccagggcttgtgagtgggatgaattgctgactggcaagctgagtaaatttgaccaagaggcctaaactgagggggaaactggtctctttatgagctctattgacactgaatagaaatatgggctccattccaatttgtttcctagcaaaataaatacataaatatcaagagaacttccttgttttcagaaagaggaaagagttgaagttattgtaagtataaaaggcaaatgaaaaggagatgagtggttttgaggatacgataaaaatatctcggtaggcagttacacgtaagtgtaagaggatactctgaaatctttcctggctgcgagagcgagaggagtggattacagcacccagcaaggttgtgggtgtgattatattcgcgggtgtgctggacttggacaccggaccaactaacagcataaacctttgaaataacgtgtttgtttttgccaaaataacaacacgctcatctcccttaaaatgtcaacattgcgttaaagtctagatccaaatatgcatggaaatatttattgagtgaaagaacgaacaatatatgtaatttagaactatgaagagttgccggtttaaagaaatcctatgcattttaagatacctagacaaacgccctgttcctgacactgtttagctctcacatcttaccactgcatttgctttaatcagggatcttaagactatcttgtgggctccttcttggtaggagctaaattgttacaaccaacatttcacacttttcaagcagataatagcctgcccacaggtagtgtgtatctgttattacatataataaaccaaacattgaaaagttaactgatagatcctttcacacttttagtttcttacagcagttttgatcatttatctatttaatattttcatgtcctgataatacatggttattgtaaaaaatttaggaaatataaccataatgaaaatatggaaattactggtagt

SEQ ID NO: 10102 - DNA, 2322 bp, artificial; identical to SEQ ID NO: 9149
  synthetic oligonucleotide

SEQ ID NO: 10103 - DNA, 2947 bp, artificial
  synthetic oligonucleotide
aaataacttctacctgagaagtaagggtggattctttgggataaagctcattaagaagtctgtttacagtccccgaccccagcccctgcccaataaacagagtaagttagaaaacacacacacttgtatgcacacacaaacatgaccttcaaattagaaaagtgtgggcaagtcatagattttttttttttttacagtgagtgaacaaaatacagaattaaaaaaaagaagttcccaatgttatctacaatctgtcaagtttcctgctcatcctgctttgccacttgcttacatggactttgtaccctgtcagctgccctgcaaaagtgctaagcacaggtatccggaagaaactaaaccacaaggctggtatgtcagactgcacggctctctggccagccctgctcacattgctgaaagccaaagaaagtctggcaagctatttttcaatttcctggaaataggtattttggctgatttaagaaatatgaattaattaggggaactcactgtgcttgtatggaggtttattctgaagtaccttctcatctatttaacaagggtctatttgattgccacagtaatccagtgaggtacgtaggaaattgctattaaccatattttacagaagaaaaccaaagtcctaagagtttaaacaacctttcccaaagaaatgcaaacagacaagagtaccagggctggcactcaaggcatttgttcattgtctcacttttttagctcttccactttaattttttaaggtccaataaaaatataacaaaggggattcacaaggtgtgtttaggatggtaaactagaccttctaggaacataaggcagtatgatataaccttttaggttccatgactggcagaaaatacgaacaaacacctctgtaaacacagtggcaagaataactctctggagagggttgtcatgcctctgaatgtgagttgactgcaaagtggaacccccaaaagacttttttcctccaatcttggaatctagttccatgttctccaaaaccacttgactccatgcacagtgagtgaacacggcccactcactgcatgggaggggtcttggcttcatcagcacagctcagccaacattcagaaaagtttgttacttcctagataagaaagagcagcagttttataccggagaaacctgggaacaccaccttaatccagtaatcaaagttaatatcaccagtaattaaacaaactgacatcatagcctcctgataagaggtactgagaaggacccaacacctctgccacgagattcctgcccaaagaacacaacctgaatgcaatcagaggaaacgtcaggcctatccaaactgaaggcagtcctcaagacgactagcctatattctttaaaaatgtcaaggtcagccgggtgcagtggctcacgcctgtaatcccagcactttgggaggctgaggcgggtggatcacgaggtcaggagatcgagaccatcctggctaacatggtgaaaccccgtctctactaaaaatacaaaaaattagccgggtgtggtggcatgtgcctgtagtcccagctactcgggaggctgaggcaggagaatcacttgaacccgggaggcggaggttgcagtgagccgagattgcaccactgcactccagcctcagtgacagagggagtcaccatctcgaaaaataaaataaaataaaataaaataaaataaaataaaataaaataaaataatgtcaaggtcaggaaaaagaatggctgaggaactgtttcagttgaaagaagactaagaaggtgagacaattaaatgcaatgtgggaccctgggttggaccctggaccatgaaaaaaaaaatgatataaaaaatcttattgggccagacctggtggctcatgcctgtactcccagtacaaaggagagggcgaggcaggcagatcacttgaggtcaggagtttgagaccagcctggccaacatggtgaaaccccatctctaataaaaacacaaaaattagccaggtatggtggtgtgcccctgtaatcccagctactcgggaggctgaggcaggagaatcacttgaacctgggaggcggaggttgcagtaagccgagatcacagcacggcactccagcatgggccacagagcaagagtctgtctcaaaaaaacccagaatcttactgggacacctggcaaaagttgcacatacattagaaattaagtaacagtaccaagttaaactttctgatttccataacaatggaaaataatgtcttcgttcttaggggcaaaggggtatgatgtctgcaagttactctcaaacggttctgggagaaatctgggtatgtatgtctgtgtgtgcatctatggaggatgaatgtgagagactgtgcaagactgagtgagggtgataggggatgggaaggatgacagaaatgtggctacacattaatacaggataaaaggtggggaagaaagagttctgtgttctagtcttgtgattcttttgcaaggttgaaatgatttcgaaatttaaaagctgaaaaaattggtctaaattcaaatgatcctctgataagactcaaaaatacaggactgagtgagtatatagatatggctgcaaggaggggacatcacttgacattttcaattaccctcttcaggaagaatttcaggtaagaatgtaaaagcctactagagaatgatgtggtggcaaaaacagcagttaagtcgcccttgtgggagcctagtgtgctgtagatgcttatctgtgggagaggataaccaagccacacatctcccagagaagcttatgggaagggcacttggccaggatccattaaatgtcctcagccaccaaagggatagcctgggtctgggagggagccttccacgggcctgtgatttggagtaaagtgggaggtacttgttttgggccatccagacaccttt

SEQ ID NO: 10104 - DNA, 270 bp, artificial
  synthetic oligonucleotide
atccttaaaccagagaaaaatgtaaacagttttaaaaggagcaattcaggctgcaatgcagacttagacaaagtacatactgccatcgtcattttttggagagcatcagcttctggggagacctatcagctgccttggcacgttctcccgccacccttctgtgtggctttcttttttaaatgctgacgtgagaaaaagaaaattgtgaagcagtaggacaaatagctttctcaacccttgaaaacactgttgtccagattgaccctagtt

SEQ ID NO: 10105 - DNA, 302 bp, artificial
  synthetic oligonucleotide
ttttccctggaggactctcaaatcacctttttcttttttcctaaatttgaatgcatttcataatcttcttctgggaagaaattagaattcctgaaaaaatgctaaagcaattctctgatactctttaatgagattaagcccttgtcggggagactgctccctccaccccctgcccccgtctcagctgacctaaggtcagaagtctagtgatgtttagccagacattctttcaccttgtgtccagtctgacaatgatcatctaaccattcacttcccagaaaatgtcccaaccaagggggaat

SEQ ID NO: 10106 - DNA, 1274 bp, artificial
  synthetic oligonucleotide
attgccaatgatggtgtcctctttaaaaactcagttattaccaacaataagagagtctgttcatcttctgggagcgctgttaggggaaatccactggtacagctgaagagtaatctttcagtaaagggagttagcaccacctttaacagctttgggaagctttgtgaccttcaaagcagaaccaaagagagaaagaaatggaaggagggaggtcaaatgaaagctagcaatcagaaaaaaataaggcccaaacagcctggggccagtttttgttttttgtttttttttagaagaaaattcgaggcctaataagggcgatttcctcagcttcctgagtcaccacccatgctccccccatttcctctccgttccaacattgaacatgaaaattaactggagctgtaaaaatcattcccagggagaagagtttctgcagtagagaaagtcaaaggaagcattcagaattctaggaatatcccatggagatgggcgaggacaaatgtaatgcaaagtgaaaagtgtgtgggtggtttgtcagggaaaagggtcgggaggaggatgtaaaccacaaattaaacacgattctaaaacttccagctggctcttcctcctcatcttcccccactcttgtgacaggtgtgacaagatcatgagaaaacctgttcactgtgtggggctttggggcacacccatttttgctaagtgtaacctttctgcaacttgtaagaaaccatatgtggcattgacccaggccagtgtgctccatctggcaagtgtttctggggtagcccgtttacagcgagtgggagaggcagacccatagacacagaaaaacagaacccccatacacagagacactgatgcacaagcatagagactcacatagagaatacagataggcacacagacacaaataggagagaaacccataagaagagatctcccagcctccagggtggcccatgacacaggtagccttagtagctgtgtttcattcctccttccacctctggctctccgagctgtcactcatcccagaggttcctttgtcctagatcacaacttgctctttggaattgtacctcacttcaaattattcaaatttagcacaatgtatatttgtattttctaaaaccgtaaatccacaggtttgtgtgcatatctgagtcatctgcattcactagtctcttacctactgctttcacagatgtgggctcatacttctgaactcaaatgcaaattttctcaagcaattcagtctctgtctctctctc

SEQ ID NO: 10107 - DNA, 1160 bp, artificial
  synthetic oligonucleotide
gaagtgctccacacagctgagagcgactccctgacatacaacctgtgggcacagagagggcacgtgagacctggtgtgcctacctctagtctaggcacttcaaatctgtagaaaagacaaacttgccacctagcttgtacattggttaacagaatgagctacaatctcatcttgggctgttttgtcaagagtacaaagccatgtactagatgagtggctctcacacctgtctgcacatttagaatcacctgggaatttaaaagaaaatgccgatgtctgggccagactccatacccattaaatcacaatttgggggtggggaatgggcacaggaaatcagtgcttttacaatgtccctaggtttttccagtgtgtaggctgagaatcagtgatttaagaggaacgcttctcaagctttaatgtgcatgcttctcacttagggattttgtgaaaatgccaattcaaattcagtaggtctggggcaagtctgagattctacacttctaagaggttcccaggtgatgccaatgccgctactccgtggaccatactttgagtcacaaggttcctgaaaacgataagctccttgaaaatgaggattcttatcttcacacctctgtctccatctaattcctgccgtagtgcccggaacatgtcaattctgaataaatgttgactgaatagatgaatgacccaatcttcctccagactgttgttccacttctctccactttcaaacatcagaagtgaggtcaaactgaacaagggggaagcaggtatagaattcctacacaaaggaagcttcatctatatgatcaggctttacctgctgatctgttctgaatttattatttattcaaaattgtggcaaaaactttaaaattaccccaaaaaggaaggctacattttctcaggcattgtaagtgtcttctttgagttcaaatgggaacatgcagcttagaaacagacatttcaaaccaaaaactgaaaacataaaaatgggtacaccacttgatgcaaacgaaaaagaaatgtattctgctcagtcacttctggtggtcagctgcccccaggctccccagtcccaatttcccagaagttatccagcatggctgttcttcatgaccttccctgatatcatttgaggagaaaatgagtgt

SEQ ID NO: 10108 - DNA, 984 bp, artificial
  synthetic oligonucleotide
ttgatccgcgttcaagtagacagggcagaactgtccaactgctacgtgatcttttaaagacaaagttagtggcagaccatttacagaaaccagatgttctgtcttttggctctgagcatgctgctaatcttcatcatctagtgtactgaacgagatgtactgaacgagggctgcagagctgcagcaccggcaggagtaggcgctcggtaggacggggcctgcacaacctccccggtagtcagcagagcggaatctaggaaggctcctttcccgcggcgccctggaggcgggggccccaccttcccacgcaggcgctatcaagccccgcctcctcacccgcccgcggcgtggcgtcggaaagagccctcagcccctccctctctggcgctgatacccaatgggcagcctcaggcctttagcgggggcggggcaccccctggacgccgttctggttggcccgcggcccggcgcagcgcatgacgttattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggtgagacctcccgggcgggccgggatggggcgcgagtggggctgaggcggggccggagggcagggcgggccaggccgggccacccagagcggggtggaaggcgccaggggagccggggagcctttacttcgcctccgcgccctgcattccgttcctggcctcgggagaagcggcacggaccgggatcacgccaaggtccgtgtgaacttcccccttctcgacacccacctcccgcccccgggcccagctgtgcgccaggcgaagtcggtgtgctcaagaggtgcctgttgggttacaggacacggaaaggg

SEQ ID NO: 10109 - DNA, 550 bp, artificial
  synthetic oligonucleotide
gcaagtaactggtagagccaagatttgaactcaggcagcctgactttagagtctaggctcttatcccctctgccatgcttttgggtggctgcgcatctacccataaggccagttttccctgtacaattcccacttctagctcccagcttgcaacatagaacctgtgatttattagaggaagatgctactctgtggtgtaagagaaatgtcagaagcctatcccagctcaacagagcacaggaaaattattcattccatccctctcaataggcagccaaactttccatactgcagatgactaacaggtagagctgattgtgcccaggagggcaggactctactgccaaatgtcctggctggtgatgctttcccctcctgcaaagagtgaggttcttccaagcgacattggtattctccatctcccccacgggtgtgtgacttaggtaagcctgccaaagtcgcacactgcacctcatccagggccttaaaagaactggtcctgcactgacggcaacttgcgaagcataatgaattgcagattccttctgga

SEQ ID NO: 10110 - DNA, 1884 bp, artificial
  synthetic oligonucleotide
cttcagtttgcgaagtcgtacctttgagccagaggggccagcatgtcaggcggggaatgaaggagtctgctgacttggttgatcatttctcctgcgaggttaggctccaggctgcccaaggacagagccttctccatctgcaacacttggttctcaagatcagaaatactgctggtgttgacgatgtctatatcaaagagccaaatcgtgttatgaacacacaatggaaaacccactaataaagataaacgtacatagaccctgtgatatggcaaactcactcctgggtatttgccccagataaatacaaacatatgtcttaggaagacttgttcatgaatgtttatagtggcctttttcataatagtcccaaactagaaacaacccgaatgtccatgaactggagaatggatcaacaaactatggtacctccatacagtgaaatattattcagcaataaaaaggaattaactctaaatacacacaatggcatgggtggatctccagttttccaatacattatgctaagtgaaagaagccaaactcagaaggccacatactaagtgagtctcttcatatgatattctagaaatatccaaaaacctgtatggaaacagatcagtggtggccaggggctgggggtgaggggattaggttttgacttcgaagggacacaagggaactttgggagtagtgggaaacttatgtatcttgattatgatggtggttacgtgactgtgggtgtttctagctgcacagaactgcaaaaatttgatttatccataaaattggatacattttactgtatgcaaattttacttcaataaatctaaaaaatataaagcacatcagtgtatttagtatatactcatataagcacaagtatacttgtatttaatttgtatcatgtgtacaggattttatgtggattgctggaagctcttttgtgaaaaagagaatattatgggctgggcacggtggctcgcgcctgtaatcccagcactttgggaggctctgaggcaggtggatcacctgaggtcaggagttctagaccagcctggccaacatgggggaaccctgtctctactaaaaatatttaaaaaattagccacgtgtggtggcatgtgcctgtagtcccagttactcgggaggctgaggcacaagaatcgcttgaacccaggaggcagaggttgcggtgagccgaaattgcgccactgcactccagcctgggtgacagagtgagactctctctctctctcaaaacaaaaaagaatattatgaaagctggactatcacctgtaagtctgatttttaatagggaaacaatgatacaaacctgtctttaacaacagacaactcttaatttcaccacttaacatcctattattttgcctattcccgtcaaatctttatgcatgtgtatttacactgttataaacatggtgtgcaaactatttgttgttgggctattttcacctcacatcaagacttgaaaatgcccccaagtttctgtatatttctgtttctgttctaatgacttacatggtcgcataatagtcattgtgttacagtagcatatcttatttaatcattcctgtcttctggaaccattacgtttattctaatttttagctcctgggtaacacctcaatctgtatcttttatgaatatgtcactttgcttcttgttgccccaggaatacataggcaccagaggccaccttgatagtgttttgtgtagcctgttaggctgagtctagggatcactgggaattagctttgggaaggtgggcatcttaggcccaggctaatgaacttcaattttactgtattcttcatcagccattggaccttcctttgactacagccccaatgcttttctaat

SEQ ID NO: 10111 - DNA, 1552 bp, artificial
  synthetic oligonucleotide
gtggcaatggggtggtaatcactggctagcaaggactagattcaaatagcaaactcttaattgcaaggtctcaggtcacaagagggccagacctgggaaggagaatgagttacatgagagggtagttccacgcgttccctgggggcggtccctccttacctggtaacacaggatggtttgctgcaccagccgcgcgtacccgtccaagcggaccccggaattgctcctgctccgcatctccccgaggctcccaggccgcagcgcccgatctgccgcgtgggcgcgggacgtcggggctgtggcctccaagcgggtctggttcccggacactcacagccttagtcggttcttgggatgggaccgggccggaggaggtcgagacttttctaaacgctagccccaaagtccggttggaaagcaagccaaccagagctccgcgcggcggggaggcgcgggggcggggacgggggctggagcgacgaaggtcccgcctcggccaggcctgctgggctcccgacgctcgcgggagcagcgggaaaccaggttccgggagtggggcgaggacgcccctgccaagccccttttacgtcccggcggtcgcgaggaggtcccccgggcgcgaagaagacgccagcccaccccagccgccggggagatcgcccaggccgcgctcagccccgcccctggctctgcccccgccgcggagcggaaccctccaagtcgcggcctgaggaggaaggaaaagggggcggcccgggagagccgctgcgaaatcagcaacgggcgggaaccaggttgcctccctgagtcccttctctccccggccggctgccaaccacagccaaggccagagaaacaggcccttctgccgcggccacctgggcgccttggacccgccctccggactcgcccccgcccctgccgcggagtggaacgtttggaaccctgaggggcacaggtaagggggcggccccgccccgcgccctggaacgacctcacggccccgcccacatccccgcccctggccccacctccgccgcagagcggaaccctcagagtcgcggcctcgggggggacgaaaaaggaggcggcccgtgggagtctaggggaacccggcttcgggcggcggacgagttggctttcctgcgtggtagtgtggagccccccgagacgggtgccagtcccactcgaggccggagaaagagggccgcctaccgcggccgcctgggcacccctctgagggccaagattgtagtcccacctctggccccgtctccgccgcctagcggaactggagtagcgggacccagcccggaagaaaaagggggaaggcccggagaggtgccccagcgacacctctggcgcctgtgaccccgcccctagccacttgggcgccgcttcctcgggcaggttcgcagttcatctcccacgggtctacagcttgaaacttggcattcattataatgtttcgtggctgctgataacctacagttcacaatcttcggcctggtattcattgtccaccaaaatctggcccacataggaatttact

SEQ ID NO: 10112 - DNA, 11226 bp, artificial
  synthetic oligonucleotide
gaaactctttctttataggcaatgtctgtaattggaaaatgtaccaacaatgtaacagacccactttacagacatcagtggatgagtgagatataggaggtggacgagatgcaaaaagtgaccgtgtgtttttcattgggttgtggcaccacaacatagaaagaatcccacctgggactgaagtctctgtatgtggcagaataagcagagggttggactaaagcatgaatttgttttatagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacaggtaggtaatcagggtgttcactgcagtggcaacaatgacactagcgtgcatgttgtcccttacaatatatagataaaaagtgactttacctttacgaggagaccacatgattctcttggaattcatcactatatttttaacagctttattgagatataattcacataccatgtaactcacccatttaaagtgtataattcaatggtttttggtatattcacagtgttgtacaactagcaccacaatctaattttagaacgttttcatcatctgaaaaagaaactacatacctattagcatcattccccattcccttctgtagccaccctgtgccacctaacagccttaggcaaccatcaatctactatctgtctttacagatttgcctattctgaacatgttgtagaaatggacacatatgtgatgttttgtgtctggcttctttcactcagcacaatgttctggaggctcatccatgttgtagcatgtatcagtactgaacatctatttgttgctgaataatattccattatatggatatacacattgtatttattcattcataagctgatggacgtttgggttgtttccactttttggctactatgaataatccttctatgagccatcacatacaagtttttctgtgcatgtatgtttttatttctcttaagtgtgtacctaggagtggaactgctgagtcataaactaattctaaaaaagtttaacattttaagaaagtcccaaactgttttcccaagtggctgcaccattttacatttccagtagcaatggatgaacgttccaatttctccacatcctctctaacacttgttattgtctatcattttgattatagccatcccagagggcatgagatggaatctcattgtggttttgatttgcatttccctaatgactaatgatgtcaagcatcttttcatgtgtttattggatatttgtagatcttctttggagaattgtctattcagatcctttgcccatcttaaaaactgagttatttatctttttattattgcattgtaggaggttttttgaatatattctaaatacaaatcctttatcaggtatattatttgcaaataccctctcccattctgtgggttgtcttttcccctttcttgatggtgtcctttgcagtacagcagtttttaattttggtgatgcccagtcaaaatgatatattttttctctttggttgctcgtgtttttggtgttgtatctaagctattgcctaatccaaagtcataaagatctattactttgttttcttctaagagttttatacatttagctcttaaatttaggtgtctgatccattttgagttaatttttgtgtgtggtgggaggtgagattccaaattctttctgttttatgtggatatttagttatcccagcaccaattttttttttcttttttttgagacagagtctcgctctgttacccaggctggagtgcagtgacacgatctcggctcactgcaacctttgcctcctgagtagtagcttggattacaggcatgcattaccacgcctggctaatttttgtatttttagtagagatgagatttcaccatgttgaccaggctggtctcaaactcctgaccttaggtgatctgcccgcctcggcctcccaaactgctgggattacaggtgtgagccactgtgcccggccaccagcaccatttcttaaaaagactatactttccttgttaaattttcttgacacccttatcaaaaaatcagttaaccataataaaagggtttatttctagactcttaattatatttcacaatctctatgtttatccttatgtcagtactgtacaattttgattactgtagctttgtgggaagttttaacattgggaagtgtgagttctccaactttcttcttctttttccagatcgttttggctattctgggccccttgaatttccatatgaattttaggattgatttgtcaatatctaccaaaaagcagctgggatattggtagggttgccttgaatctgtaggtcaatttgggtactatggctgtcttgagatgtctttccatttatttagatctttaatttcaacaatgttttttacctttcagtatacacgtcttgctcttgttttgttaaatttattcctaggtgtttttgatgctattgtaaatagaattgttttcttaattacattttggattgttcattgctagtgtatagaaatacaactgacttttatatactgacattgtgttgtgaactttgataaacgtattagttctaatggtttttagtggatttcttgagattttccacctacaagattatgttatctgtgaataattttacttcttcctttccaatctgtctgccttttcttttccttttttttctttttgcttaattgccttgtctagaacctccagtacactgttgaataaaagtgaagagagtagatgtctttgtcttgttcatgatactggggaaagcattcagtctttcatcaagtatgatattagctgtgtatttgtttgtagtggccttttattacattgaggaagtttctttctatgcttagtttattgagtgtttttattgtgaaagagtgttggattttgtcaaatgctttttctgaatacattgaaatgatgtgttctttccctttattctattaatacagtatattatattgattgatttcagagatgttaaaccaacctgacattcctgggataaatcccacttggtcatgatgtataatccaccttctatgttgctggtttccatttggtaatattttttgaggatttttgcatctatattcataagagctattggtctatggttttcttatgttgtgatatctttgtctggttttggtataagtttggcctcataagaggaattggaaagtattgtctcctcttctgtgttttagaaaagtctgtgaaggattgattttaattcttcaaatgtttgatagaatccatcagtgaagccatcagggcctgggcttttctttgcaggaagttttaaaattactaatttcaatatttttccttgctatagttgtattcaagttttttgtttcttcctgagtagtttgtgtcttggtagttgtgtctttcttggaatttgtttcatttcctgaaacaaatttatttcatgaaattcatttcatctaatatatctaatttgttgacctaaagttgtttgtagtacttctttatttttttttctcctgaaagtttggtagtaatatttccttttttttgttggtcagtctcactaaggtttgtcaatgttattgatctttttgaagaaccaacttttagttttattgatttttctctattgttgtctattctctatttcatttatttctgcactaattgttaacagtggagggtgtccaggttcttggcgtcttgaacaatgaattggacaaaacgcacaaacaaagcaaggaaggaatgaagggttttactgaaatgaaagtacactccacagtgtgggagtggccccgagcatacgggctgaaaggccctgttatagaatttctgggagtttcaatacccccagaggattccattggttacttggggtacaccctatgtaaatgcagagtttgaagtaaagttacaaagtcatttacagcataagcccaatggagaggatatttcctgtcatagctgaagtgtgaactggccttatgttccctgcctccagaccttattttcctgcctcataatctttatcatttccttccttctgcttgttttgggtttagtttgctcttctttttttcagtttccttagaaggtaatatcattgacttgagatcttttttattttttaacaaagatacaaatttccctttaagtactgctttagctccatcccttaagtttgctatgttattaaacaattgctgctgctttaaaaaaaatagttttgctatgttgtgcttttgttttcaatagtattgtctaaatatccttgtgatttctttaacttatctgttatttggtagtgtgttgtttaatttctacatatttatgaattccccatatttctttcgcttattgatttaaaatttaatttgattgtggtcagcgaacacatgctttgcctgatttaaattcctttaaaactttttttctttttttggtaaatccttttaaaatttgttgaggctttttttgtggcctagcatatggtttatcccggagaatgctccatgtgcacttcagaagactatatatttcactcttattgggtggagtgttttatatatgtctctttgaacatatttataatagttgctttgaaatctttgtctgctaagtcgacgtctagtcccttcaaaagcagtttttattgcctgcttcccccctccgctccccccaccccccgcccgtgtatgagtcatacttttttctttgcatgtcctgtaatcttacattgtagtaaccctaggtagttattcccatgcccctctggggcttgttgttatttgcttttttgtttatttgttgagtgacttgtctggactagtttagtgaagtctattccccttcagtgtgcagcctctgatgtcactcttcacagagtgctgccttgggcatgcatacagtttctcccaccaccagggctggtgtggatttaattgggctctctttgactgtctctttccctgatctctcctttaagcttcggacccatctgcctctatttgaagcagtcccagctgttagccttcactaattgctagccgattgctctattgtttttaacaataacaatgccctggcccacagagtgctctacagtctgatccgattaaagttggacccctttgcaggggcagggctttaaccatgtttgaggcttactccaacctccacaaaggctcttttctcatctgtgtctttccccgattcagtctgttaaatttcttctagctggggtactgttactactagtatctcggcactaccatcctcctcgtaaatgcttattcccaacaatctccattgttttcaacagtgcctttaggcatgaacttccttacactctgtgccaaataaggccagtcccttaggaagagtggcagtgctctgttcttgacctgcctcaccccctgggccaaaccactgtgccatcgcactgcagctgggagcagggacagtgacccacttctcctccagtgacagccccattccacaagtggggtagtaggcagggatgatagctcctggtcttcttggcttgcccttcttggcatagcacctcctccttatgattgagcaagcatgggggcagttggggtctagcacctgcaggctgccatgcctaggatagggcttctgcccaatgagcgggagaagtgaccccagtcctctctgctgtgcttgcctggaatccagcttctgtaacgcagagctgaggggaatgagggatgcccatcagcttgctccttctggggcaaaaccatagccctctactgggagctgggggaagaaggagccccgtcttggatgcatccacttgaagtagagcatccttcatgctgatcagtgaagggggttagagtagatcatggctcaaatgccacagactctctctgttggtatcaaaatttagtaagttttcttaaatgtttctccatatgctgtatgccattaggacaatttccagtggctttaactattttaatttttttttaagtgattttccgctgggcgtggtggctcacgcctgtaatcccagcactttgggaggctgaggtgggcggattgcttgagcccaggagttggagaccagccttggcaacttggcgaaaccccatatctataaaaagtacaaaaattagctgggcgtggtggtgcatgcctgtagtaccagctacttgggaggctgaagcaggagcatggcttgaacctgggaggcggaggctgcagtgagctgagatcgtgccactgcactccagcctgggcgacagagtgggaccctgtcttaaagaaaaagatgttcaccagttaaatggttgtttcactggggagagggtctgccaagcccctaacactgccattcctgtcactatgttgtcattttgagaactgtactgagtatgtctataaacatggatgtaaaggcaataagccatgtactcatctttgtgacagcgtgcatatccagagctgcctgtctggagtctctggcagcttctggcatggagtaagatctataaatattcctctcattcattcatccattcaacaagaatgtattgatcactcctgagtactcttgctcatttgtcttggtgaaatttagcgtttttctaaatttccagtcctacattttaactgctttcttgtcagtttttaccctatatggcagggatgagttcttaagaacaacagctatgtgcattatctcattaaatccttaaagcaacctgatgacgtagataatattattcctatttcccgaaagaggacactgaagctcacataagttgaataatttgctaaatgatgggtctggttttgattccaaatttgttggactctacgcttctcatttttgactgctaggtcataccatgtctctcactgtaggaaaagatgttacaggacactgggttttgtttgtttggttggttggtttcctttttttgagatggagtctcactctgtcacccaggctggagtgcagtggcgcaatctcagctcattgcaacctccacctcctgggtttaggcaattctcctgtctcagcctctggagtagctgggattacaggcatgtgccaccacgcccagctaatttttgtgtttttagtagagactgagtttcaccatattggtcaggctggtctcaaactcctgacttcagatgatccacctgccttggcatcccaaagtgctgggattacaggcatgagccactgtgcccggccccagaactctggttttcaacttcttacatgggaatgttatgacctcttagaaaggacttttgaagacttttcttcaggtttcctgttctgaaagaaatgaaataaaattattggatatggactaacgcttaatgataaaagtgttcttcctgtagatagaatcataaccataataagtagctttcgttttcagatataaacacacatacatgcatttgcaatgtcacaagtacacatagacacgtgcccacatgatgttggttacatctgtagctgggaaacataattaaacaattaccaaacagtgttaaatttcttacttcccttcagtaattgttaaagaaacctctttttcttgatttgggacccttataccttgattgctgaaaatgttgactaaaatgtgatttctggtgtaaaatataccctaatcaatgaggagagagagaagtggggagacagactgagggagaaatggaattcatcattggctgtgagtccaaaatatttaaaaatcaagtaagcatgagaggcatctcatagcaagtaggaaaggatgcctccttaaaccttgacatccaaatcccaaagactgaaggttagaacaagctcttctaggattatggtgaataaagaagataatgttaaagaaattggagctgcacacaaagaaaattgtggcctctggaagcctagaagagttagaagagccttaagaagtgggagggaggagactggggctcattattccataacagagcctcccactccccaaacaatagagatacagcatcttgcagaccccacacacatgatcagagctgacattgggtaaaatgggccagaacctcatttctgatgtttaatcattttagttgtgcccctaattttctttcctcagttcctggtacatagtggatacacacacacataagttatgctagagccgaaatttccagataaaaacagagctgacaattactttatttcttaatatctatgagctattttgtataaagatcatatactctttattttgtcttgtagtcatggaaattcataattcttggcagagtgctatagtttaaattttcccttatgttcactgagatgtggggatatatttaatcggagttaagtcactatacagagatgaatatgatactctttaagacagacttacaaagagacagaggccagaaaggtttcaaaaataattttaattatttatagtctgaatgactcccctctctttattcattcatttaacaggtatttattgagcacctactatgtgtcagacactgttctagacttctgggaaatgtcaatgaccaaataaagatccgttaccttgcagagcttacattttagggggaggagttagatgacaaacaatacagtaatgagtaaatgatatgatatcttaagtgatatgttcttttttattattattattatttttagacggagtctcgttctgtcgcccaggctggagtgcagtggcgcaatctcggctcactgcaagctccgcctcccgggctcacaccattctcctgcctcagcctcctaagtagctgggactacaggcacctgccaccacgcccagctaatatttttgtatttttagtagagacggggtttcaccatgttagccaggatgtctcgacctcatgatccgccctgcctcggcctcccaaagtgctgggattacaagcgtgagccactgcgcccagtcttaagtgataagttctatgggaacaataaaaactagagcagagttaaggagaacaggaaaactggacttggggacaaaattgcaattttttttttttgtttgtttgagacagagtctcactcctgtagtccaggtgggaatgcagtagtgcaactacggctcattgcaaacctgaccacctgggctcaagtgattctctcacctcatttttttattttttatagagatgatgtctcactatattgcccagactggtcttgaactcctgggctcaagcgatccttcctcctctgcctcagaaagtgctgggattacaagcatgagccacggcgcctggccaaaattgcaattttaaataacgtagtcagcagcattgaggaggctcccaagagggaaatgacttgattgaggtgtcttggctggtcaggaatgatagagtaggatttgatcctgaggttgacttgaatgtccatgctctttttctgaagggatagatgagagtgacaggcattctcaggaaggacgtgacctactttagtcagcccttattcaatgaggcctgaagggtggacagggagcaggaggaaggcatttaaagaaatctaggtacctggctggaaggtttgggctgagcacggctttttttttgagatggagtcttgctctgtcgcccaggctggagtgcaatggtgcgatctcggctcaatgcagcctctgcctcccagggtgaggcaattctcctgcatcagcctccaaagtagctgggattacaggcatctgccaccacgtccggctaatttttgtagttttagtagaggcagggtttcaccatgttggccatggtagtctcgaactcctgacctcgttcatgatccacccatctcggcctcccaaagtgctggaattacaggggtgagccaccatgtccggcctgagcatagcttttaaaatgacatggtctaggccaggcgtggcggctcacgcctgtgatcccagcactttgggaggccgaggcaggcggatcacaaggtcaggagttccagaccagcctgaccatcgtggtgaaaccccgtctctactaaaaatacaaaaattagccgggcgtggtggcgcatgcctgtaatccctgctactcgggagactgaggcagaattgcttgaacctgggaggcgggggttgcagtgagccgagatcacaccactgcactccagcctgggcgacagagcaagaccccgtctcaaaaaaaaaaaaaaatgacatggtctagctgggcgtggtggcacgtacccgtaatctcagctagtcgggagactgaggcaggagaattgctcgaacccaggaggcggaggttgcagtgagctgagatcacgccattgcactccagcctgggcgacgaaagcaaaactctgtctcaaaaaataaatgaattaatgaattaattaaaaatgacatggtcaaaagctggaagggaggatgtataactaagggaaaatatgaaagaatagtgaatctatagtattaatgttttagaagagaagcatttagatatacctttcagagctattaactctccctcgaagcacacttttggagtctggattacttagagctgcagacatgcgcaaggtccttcttgaaggatttattttagattgaggagatttaaaaggctgacacacaaatagatttttgttgaccaggtcatataaaagctgtaattcagtaaaacgttcccattttttttgtttgaaatttttcaggaaagaatgttgtaaagaattaattagtctttcatgcagtgatcaccccaaggatcctgcatttcagaggataatgtgttgttgagatgaaagagatggtttctactgaggaatttgtttcaccaacaaatgggcttttatgcaatttttttgtgagttctgcaattaatcttacgttaccactacgatctgggtaaacctagtcaagtaaatgatttctagacagaaaaaagaaatgcagaactcagggaatggattctgaaggacaagctcagttcttaaaaactgttaccccttatgacttagaatcaaagaaaaatgagtgtcagatatatcttcctcattcctttga

SEQ ID NO: 10113 - DNA, 2120 bp, artificial
  synthetic oligonucleotide
gctaaattgtgtgttgggtaggtgtgtgaggccaggtttggaggtgtggcaggttcttcgaacagatttggatgcagtcgttctgttgctactcttggcttgcctcagatgttgtctcagaaactagttccatgtttttcaccgatgcgtgtattgttttatgacatgataattgcttctggcattgttgctcataaacatatttacgaacacagcatttcaactatctaactcaccagaaacttgaggaataaagattggttagatggtttaagaatctttgctggaaggcacagtaggtgacaaatgttcccttttcccttctttttttcttcttcttttaaaaaatctcttgttttatgaaaaacagaaatcagtttgctctaggacagtggaagatatggcatgtctcatgcttttggtcctgggcttttgggtgccttgatcaaagctcagcaactgattagttttgtctttggggcagttttggcgcctggcttgagtacagagtttcaattctaattctcaaggtatggaagcaaatgctaaaactatgaaggaaaaaaatcccaggactattatcagaggcccattatatataatatagcttgatacttttatttaggcatgctgtttatccttattgcctatcgtatttatctagtgtctataatggttaatgaaggagacgtggcccctgccctcatagagcttacatctagcagggaagatgcgtgttgagcaggtttttcaagtgtgatgagtttgtaaagggggaatccaaccttgtctgagggatgatggaaggttcccccatagaaatatggctttagcctgagagctgaagaatgaattaggcaatcaagaaagagccatagagggggatgggaaacagtgttccacagtgaggggacaacttatgcagagctcaggacaagactgtttagatgtgaaagaagttcaggaggacaggagcatagactgagggacagggtggtgcctgatagggctggagacataagaaatgattggatggttcaaaggaatttggacggacttccaagaacaacacaatgtcaccgaataatgtcataaaatttgtgttttaaaatgcagtaggaggagagagttggagaggggcaagagtgaatacacgctcgtcaattaggaagtagttgaaggttaaagggatagataatgggttctcatttagactagggtagtggtgatagagatgcaaagaaatagattcaagaggagtttaggcaatgatgatttaaggctcagtaactggatatgggagagctgaaagaggagggaatcggccgggcatggtagctcgcgcctgtaatcccagcactttgggaggctgaggcgggtggatcatgaggtcaggagattgagaccatcctggctaacacagtgaaaccccgtctctactaaaaaatacaaaaaaattagccgggcatagtggcgggcgcctgtagtcccagctactcgggaggctgaggcaggagaatggcgtgaacccgggaggcagagcttgcagtgagctgagatagcgccactgcactccagcctgggcgacagcgcaagactctgtctcaaaaacaaaaaaaaagggtggggggagggaatcaaggatgacctccagattcccagcttgagtttgggggtacagcggcatcattcacgatattgggaatgtggaaagaggagagaggttgggatgagggggaatgatgaattcagttttgggtaagctgatttgaggtactattgagtaggcagttgagtgtacatacatgtccagagatcagaaatgaagtgtggcctggaacatcatcctgtggtattaacactagataaaaactgaaagcccgggcagggatgagattcccaaaggagaaagtgaggggagaagagagcctaggatgtaatctgaaggaactaccacatttaaggtgaggtagaggagagcttgcaaaagaggctcagaagagccaggaggaaaaccaagagagtttatggtcacagaatccaaggaaagaaaagttttctagaaggatggtagagtcagctgtatttagtgtttcagagagggcgaggaaggtgaggac

SEQ ID NO: 10114 - DNA, 1612 bp, artificial
  synthetic oligonucleotide
cattatagaaaatttgagaaaaagaaaaagatcgttttaaatcttaataccctaccacaactagtattaggattttggtatattttcctccagctgtttagcctatgcatatgtttgtggcaagaaggtggggtttttttttgtttgtttgttttttaagttttaaattagagcaatccttttagtacgattttgtattctggcttttaacagtttatctatctatatctacatgcacagaatatgtatgttactacaaatactttattatcttcaatcctaatggctgcataatatttctgaagtagtcattaaaaaaactgcccatatttttaactgaagcttacttttaaagtgtcaaatcaaaatgccactcagtcagatactactataattgttacttaaactgggtgaacaaatagacctgatttaacataggaatacttaaaatgtttaaagtgttaataaaacttttatcattgtctgtagaacatgtttctctatcatgagcgttaaactttggctacctcctgaccactgttatttttattttgtggtttttgttctaaaccacaggtctcctggcattgtggggtgattaagtggtagaaagtaggaaagattaaggaattgaaggtgtttttgtatatagatttagattttgatgtttactgtagagcaacattaaacctaaagtccctggctcactgtggcacaagtagagtatacatgttggctgactttattattcagaatttagttaaattttagatattttagtaatatagattagagtaaaaaggaaaataaccattctctaacatcctctcgacttaaactttttattaggttttcataagtttcctttttgatattaaagtaactgtagaatatctctgcataggccataatgccttaagctttaccaacccaaaagttgtttgtatctctgcatcttttaattaaatgaaacataaaatttaagggctttgggatttccaaagagcgctcagtacagccttccaaacctcagagtcctacgcctgacattgggttaactctgcctactttgaatgagcatttaaactgttaatagtttttcactttctagaactcagcaaaaagaaactacatagaataagcttcaaaagatttaaggcattgtggcctttgcataagattccaaaagaatgaaaatctgatgcccagtgtacatagagacgcatgacatgttaaagctgaggtggatcctaaatctagttgaatttttttattcactggtataggaactgagcccaagcaagttgtgggcttgcttcaaagcccaaaaatcacataatcaactgggagaaccagaactgcgttctcctaaataccaagtccaggctcaattcataccatggacccgcctctgtggggagcctctaggagctctcctctggcctcttcagcgatgcaagttaaactcttcctcgaggttcctgtcattggaacaagaaaatttgtgggatgttttactcaaatccctttttacatatacccttaaaagattacctaaatacttgaataccttcatagacattctagttctctgacaattgagatatccaaa

SEQ ID NO: 10115 - DNA, 852 bp, artificial
  synthetic oligonucleotide
ctttcaatgctctttcattcatctgttaacaccagaaaaaggtcttctgataaggttcttttctttttagtacattttaactttaaagcctaagaaggagcctgtagttctcattaataattctctacctaccctagttgtaggattattttccttagattgtatttccttctttgggaccacccaaaaacagataatttatactccacaaataaaattagatatagtgataatgatgacaagtgcgcaaattgtaggtctcatttctttaatttagcatgccatacgtgtatctgggggacatgaggaatttaatttttaaaaatgttttttatataatagcaatataagtttctggattttttttctgaagagcatgatgacgacatgtttaagttactcactgagggtttattttgatattaactacttattttccagtgtctaccaaccgtctagtagtaattcttgattcattgctgacctaaagcctgtaagaatcattgacattagtttttgaaagctttactattttttttaaatcaaaagcttgctttatcctgaaaaacaaagatgcttagtcactttattatctcttccattgtgtaggcagagtttagagtttttatgctaatttttaatcttagaattaggattgattttctttgtgtttgtctatatttcttccgtgtaccttttggactcattgggatgcatagtccattttcttttgggagaattgaatttactggacactttaccaatggagaaatgagtatgaagtagatcattcttagaaccccatctgaggactcaagtgtagtagaagggcttgttataatatggtggtgt

SEQ ID NO: 10116 - DNA, 726 bp, artificial
  synthetic oligonucleotide
tctcctaagttcctggaggacagcaccatgtcttatttatatttgaacaccacctccctcacaagattctaagaattaaatgttataaaatagaaagcacccagtgcctggaatttgggatccatttcttcactgtgtcagttacacaatgactcttgtgactgtgtgtctcctcatttgggggaagggtaagaatttctttacttgtgagaagcaaaggtgtatattgttaggtagaaacacagacttgttttgctatcgttccagagtgtacatatgtgtaggaggatgcatagagaaactgagggctgaaatggatacactgtgctggttaccaatgtgttacctctcacctccaacttcacccacttttgccgactctgtgaaaatggatgtgggccctttaaatatttttccctttgccagtgacacaatttaagcctttggcagtagaaggtgctaaaaggagaatgtaggaggaaagagtttttttgcctcctggttgacctgtgctctctgaggacattgatgcaaagtgtagctttctcctgcaggagagggcagatttccagtactttaaagagggcatatttgcagcaagttcgtgaagttgcaaggttgggtttccagcaaattccagagaacagatttacagcaaagtccaccagtgcagccattcagtgagtcttagacactgtgtctcaaccctaagggtagggcctgttt

SEQ ID NO: 10117 - DNA, 1416 bp, artificial
  synthetic oligonucleotide
acctattcacagagtagtatcatcacaagtgccaatatttcatattgaagttaaaatcaattaattctttaaaatttcctgtttttgagtaagtggttacaatggggctacctttcaggattatattaattggagtatctgcaatctttagaggctcatttaaaaattaccaccctgaggatcaaagtggtggcatgtgcttcccaaattattgaaagctggtttcatgtctggctgtaaaaatacaaatcggccttttttactcagtgtcggctcagagagcagctgcttatgatataaaaaatatcacggctggctggtttacagcatctactataaatacaggaatattttattcatctgaagaaaaccatgaattggatcaagacaagttagaaaaaaaggcagaagtttagattttagtgagtgtcacaaaacatggaccaggtggaggatttgagccctgagctgcttttctggcagaaaaccctctccctctccacccgtctcccctcccctgcctcttgggattctccagagttaccatcttcccaaagaattcatcttctccaatagatattgtgtctggggacttgtggggagaataggagccgttgtgatgtgtggaataattgaaatcatggaatttccatactatcaagactactaaaagccacctgagatattatccagtagaaaccacttcatggcagaagcaccatgtcagaattccacagacaaggtgaacagccaattctaaggtcagaaaagtcactagattataagatgagccatttcatgtcaggatattagactatttgtgtattagaataaaatgcaattctctataactttcttgcattgcattggctttgctgcacataattagtggtttatttatattctgcctcattctatgaagggtttgaggcattttgcaaaaataaaatgtacacagtagccaaaaagagaaaaagaaaaagtagagagaatcaggtaaagagatgatgagggttagagaaccatacagccaggagccatattcaaaccagaaatgtattttatatggtcatttacagttgttgaaggtggcctgaaatatggctctgtatttcctaacaatcagagtgtgttttctacactgaaatgtaggctccatgagagcaagtatatgtgtctgttttgttccctgctgtgttccccgggacctagactagtgactggcacttagcaggtgccagtattagtatgcattgaatgaatgttgaatgaaaaaagaaaacgcaatcaactataagatttcaaatatttggtaagattaaaaagagtaaattgttctgaagaagcaatttctggaaagcaaacttgagaatcaattcctctgaatcctcaagtagagaacagaaagtcatgtag

SEQ ID NO: 10118 - DNA, 2861 bp, artificial
  synthetic oligonucleotide
ccctcgggtggctgaatggtcccctgggctggtgccaaagtagtcactacccccaagttccagtctgacttggttcatagtgcctgggctgccctggggatgcctctagtgggcatctgtcaggacgagaagcgagtgcccatttgaaggagactgtgtgtatgtgggggtgtgggggcaggtggcttctctgggcttgtaagaggcagagaaactgggatgccaccatcttacaattctctgccttccagcccacccctggcttctcatgttcccgtttgagaagaaaactagcctccatactgtccccttccgtattgtccccctcccaccttgccacccctctactgtaacaaaggcatgtccacaccacattttcaaagttgtcacaagtctctcggtccaccaacaaccaattctgatgactccaaaggagcaagagagacatccagaaaacggtgggaaagattccctgggaaaagcacagaaaaccttgcctgatgcttgcaaggctaagaattgttttctccctgctggctgcttttctctctgttctaaagagaagcttccaagaatcagttaaataaagggatcacaccagaggatgcgagataatgctaaaccaacaaaaacaaagacccaaatgaaacagacagagccatgagaatacgcggttatcaaaactttgtttggccatatctatttatcatcgctgcacacccgggctctgcggaatatcattctgttgatgtcacttatcctcagcaaaatatttacacatccttaaaaacgccagatgaggggggccggcccgcgcactgccgcaagccgcccctcaaaccccatcgctgggttctgaacagcccacgacataggggcacgacggtgggtggcaccagcgggcacaggtgagagctaccaacagttccgggaacacggtcacccagacgctgcgccgtgccctccccacctctcccctacctgactctgcaagcagcagccacatacccgatatggtgtcggcgcctccttgtcctcctctcctgcctttttcattgattaagttctcaaaccattgttaaagctgggttgctttttccttggaaaactgggctaaattcattaagcttccctctgccacaaaaggaatattcataaaagtttggcaggcagaaagggagactgagtgagtgccatggtgtgggtaacaacccgctcctccaaagccaccttcttcttccgtgccccatccctctctccatccatccgtcgtgccccaaacctactccaaggacttctgatagggaaacacaaagcagcagctgtttggcaacatttctacccctcgccagcaactgtggtgggatgccatttccccacccaggcggagcttatcctgaacaatagtcgggctttaaatggcaaacaagcaaacacacagagcacaaccccaaccccgaaaaagccaccgcggagagaagcaataactccctccgcagcaaaaggcgccactgaaacgcacgcaaaaatgcagcgagaacgttgctcggtgcctaacatggcagaaagcccgagctggtgcggccaccccggggctgggcattggggggcaccggggctcccggggcgccgacgcacactcacccggctccgggggggatgcggggctggccgcgcgtcacaaagaggagcccggcgcaatctggcaaaacccaactttccaccaggctcgccagggccgccagatacgtcaacagaatccatctttcgaagggcctggaaggcgccgggttttccgggccggggcagaacggcagatccggagactgcccggtgcggtgcctgggcgcggagtccgccgtgcaccgccctctgcgcccgatgccagtgcgggcggcggcccgaaacccacttcggggcccccgccccgccggccggcgccgcctccccggcagtccccggccccgccggccagtgcgcggcgccgggaacgggagcggggccccggcgcgccacacgggcggcggcctcggcccgcgtccccgcccccgcccggccctcccagccggccccggcctccgggcgccgtcctgcccccgggagcaggcccctccccgggcgccgggccccgccaggcgcgcccagcccggcgcgccccctgcgtcccggtggcagctccgcgcggggagggcgggggtgaccccggcccgcacgggggcgccgcggccactacctcgcaatcgcggccgccgcctccaggaagccgcggggtggtcgagtgtgctggaactctccggtctggcctcgccgccggccgcctgaagggggtgcgccgcggtgggagccgccgtcgccgctgtcaccgagtcgctgtcgccgccgccgctgctggttgtgcgtgagcgtgtgtgcgcctgtgtcctggcgagtgtgtgtctgcgtgcggcgcccggcctttactatatacaccaaggggtgggaggaggcggggaaggggagggcttgggggaggcggcggaggagggggagcaggaggggggcgaaagggtacccgaggaggcggcggcggaggagggacaggtgatctcgcccacggggagggcgtggccgtgggcggcgcggggtgccaggaagaaggggtgtcggggcggggaggaggaccttggggggagcgccgggggagggccggaggagctgggaccctactgcctcccggcgggctggggaccattccagaccccaggatggagaagagcgaggaacagagcccagaagggaggaagtggctggctgatggaagcgggggaggtgggaagggctcagcgatcacccgaaaatgccaattgtgataccggtggagg

SEQ ID NO: 10119 - DNA, 1481 bp, artificial
  synthetic oligonucleotide
aaccactgttccaggctgtttatcactttgtctgctggaatcctctttttacttgtctctctcccagctgagatggtagttcctctaggacaggctggagtgcagtggctcagtcatggctcactgcagccacaacttcccaggctcaggtgattctcccacctcagccttcctagtagcatggactacaggcatgcaccaccacgcttggctgattttgtgtatttttggtagagacgggggtttcgccatgttgcctaggcttgtctccaactcctgagctcaagcgattcacctgccttagcctcccaaagtgctgggattacaggcatgagccaccgcacccggccaggagctttttttttcggtccatgttctcaatacctagcaaagtagttctgccaggtggtaggccatcaataaaggtttagttgaatgagtgaatgaatgaatgaatgaatgaatgaggaaatgtttctggccctttgtttaagtgtatttttctttgcccaaagtttctgtgtatttcaagaagaattctcagatttttatcagcctcctatgtgcttgattgcaatgtttctggccctttgcttaagtgtatttttctttgcccaaagtctctgtgtatttcaagaagaattctcagacttttatcagtctcctatgtgttcgattggcgcgtaagagatgtgtacttaacggttttgtaagattaattgctgactgcgtgatttaaaaatactttgaagccaaaagtcacatctgttatatttggttcagtgttctttctggagtggaacactcactgtctgtatataatatagacttcatatttgtacatatatgaacatatatgttacatatgtatatcataaagtgagtctttgttcttttagcagatttctttcctaaaatagcaccttccttgatgtgcagtgtcttcatcatcaatgtgctagcatagaggcattgtgggacattcattcaccagcattagagcttcctcaattcctacatggagtagagcaggggaggggactactctagctcagcctgttggctctgtgtcacctacagccaggccttgaataggagcaagacatttctgatggcttgagaacttttgttgtgtctagcagttaacatttgacttaatggtattttcacgttacttttctttgaaataaaaaattatattttacattgtataccaattatatgactacattgtattataataggttatatatgatgctctgcaaaacctggataagaagattgatgtgattcgtagaaaggtttcaaaaatccaacgtttccatgcgagatccctgtggacaaatcatgtaagtgttataaaaaacatttttacaactgtgataaacctctggtttgtaaagatgccaatgagctagaagtgagagagtaccagtatctgtgtgagattagcaaggcatgtctatacttgtaacagtaga

SEQ ID NO: 10120 - DNA, 2287 bp, artificial
  synthetic oligonucleotide
tctctgccttctgcattaggtcgctatatggagagcctaccaacttaagctatgggcacacactgccatggtttttaatcctggttcaacctcagatctggtttagtaaatcgccgctccctggagattaatacatggctgcaaaggcattgtccttgcagtgtttttcagcctgggcagggtgagatgtgtctaggatgcgaggtttcagcatccggagatgaatggggggaggggacgcaatgtcacatttttcgggtgctctagtcctgttatatgcgggcacatgctctacgccagtctctgtccaccctcttgcccgggctggaggggttggcacggtcggcgtttctgattccttcctctgctgttggccatagactagggataagggaggtgagaagagagccacgggggtgcggtgctgagcagctgcggtcggtccagcctgttggtgatgtgcggagcccgccgccactctgggcatgggtaacgcgcagccccagcggtcgcgctacgggagaaggaaacacagaggtacaagaaatccggatccgggatcctccgcagcctccggcttgtctaagctcacaggccgggctttgtggctggctcccgcgcgccaccgagtttggggctggggactgagtcctgcagctcactgcggctggcagcaggggacggattatttttagcaggttccctttagcccggtggagctgggagatactcgcagagccaggcggctgtccgtggagcattggtgcagccgtgccttgctgccccggaggtttggctgccgcagtcctctccattcactgagctgtaaatcgaagctgtctacaccgacaaggctctcgatcccagcgtggccccagggctacgtcccgcccaggtctcccggcacctgatttcccagtggtcaattaggtgtctcagcctgcagcattgaagcagtggaggggccgatgcccctgctttgatggagcgcgccgtgcgcagagacctccccagtcgacttcctcatcagaaggcagcatccattcataattctctgcctgtggaccgagttaggctggagctgggcatggactcctgcgatctctctttttgcatctgaaggagaaactaagataaaaggaaaaggaagggggaatgcagtcctaacgcaacaatgcgctggaaagtccccgagaggcctctcttttgcggggagagggagaagaggcagattccgagcccagcgccccagccagctgctgcttcgctgcggagccggcacgcatgcctacctcacctgacggccgcattcccggggagccggcgcggggcccggcggcgcgcccagggcgcacgggcggtaggatttctgcaccaggggaacgatgcacgggcgggctgcccagggccgagcctgagcctgagcgggcgccaggggaggctagcctcggcgtggcgccccaccgcaaccctccgggatgctccgcgactcgcagcccaggccatgcgggtgtgtgagatgggaccagcctggggggagggggtatgggcaagtgacatcattttaaactaatttctcgcacctctgggtgctgggtgaacttgggggttgggggaggctcgaggccagccgcgcgctagcccgagaggagatcccccttggtcgagatctgagagctgggtccccttggcagagctgagcgagggtgagctgacagtccaggtggaccgcgcatagctcgcaggggcaaagggaacagcgctggctttcaggggtcttttattatttttaaaagcatattgcagctgcagcttttaagtttgccgcctcctccctaccctgatcccgggttctggggcggggcggcactttcccacgctgcctaccctctgggtggaggggtctgcaggggctgcagcgcctggtgttgggtttcctgcagggggaatgaggattcgacggctctgtgagtggaagggcgccctgaggtttggccttttgagggcttctaagggctggggagaagtcgaggatcccgcttggtgccctctcctgttttcctgccctgccacttggtgttggatgacattttgcctgtgcaggggtttcactgtcaaggagctgtgatgctgtaaggcaaatggactgttaggatgagctggaagagaggggagtgagctggagcttttccttttgtggcagtgttaaccccatcgcccccacctctctggcgcacctgtcccctggggtcaccatctgtgcgcatgagtggggcagcctgaccca

SEQ ID NO: 10121 - DNA, 1608 bp, artificial
  synthetic oligonucleotide
ccatgcttgatatgtgtttgtttcatttccagtgttacatgtattaagtgtcaacaatctacactcatgctacctcacgtttgaaaattaactcaggaagtcacaaaatgaactttttcccctccttagcaatttcccatcttcattgtgtgataaaggtttttgctaacagccaagtaccacactagacattaggtaggttcatgggcctgtggtctgttatcaatgtcttgtgttaatccaggctttcttccaaagagtttgcagtgctttttttcagacatcatatcatgtcacatctctccttcctcctgtgttccctaatctcacttaatgacaacaccatgagctcctttccctcttcccttacttccctgatagcttaatattcctccactatgccttttgcatcttccctctctttctcactttttctttccctgtcccagggcaggctcttgtcattcatacatatatatatatatgtgtgtatatatatatgtatatatatatatacacacatatacatatgtgtgtatatatatacgtgtatatatactatatatatacgtatatatatagtatatatacacatatatacgtatatatatacgtatatatacacatatatatacgtatatatatacacatatatacacatatatatatatatatggtctcactctgttgcccaggctggggtgcagtggcacacttatggctcactgtagcatcagtcttctgggctcaagtgatcctcccacctcagccttctgagtagctgggactacaggtgcatgacaacacactcggctaatttttttttttttgtggagatgaggttcctccatattgtccaggctggtctccaactcctgggatcaagcctcctacctcggcctcccaaagtgctgtgattacaggcgtgagccactgcacccagccatgctcttgctgtttcttgcttggagtattgccatggtctccatgagcccatcactcctctcctccaaaaccacactagtctcaactgattcacttgtcgtttggtccctttggacttttcaaacctcatctgtcaggacctctctcccttttcccccacaccattccctgaacgcactatccatttacatgcattccttggctcagctgtttacatcatctgcactgcccacccccccaccccaccgacaacatcctgcatgcctatcacagttcatcttaagtgttactgcatggaaagcccaccctgattgatatccataggcagaattcatcactgttcacccttatgctctgggagccctttattgtgagctcaatttcagcatttagttcagtctaactttaaaaaaatagttaattacgtgcttgaaaacaattagattgcaaaccccttgagccagggactatgtcttatttgtctctgtggcccactatagcaaccagctagtggcctggccctaatgacaacctggtaaatgaacagagtgagcgatatccctgtatcaaaggtaaagaaagattagcatttgctgctgtaaggatggctaaagggattcatttgtccaaagtccttcaaagggcaagtcaagttgagacact

SEQ ID NO: 10122 - DNA, 1421 bp, artificial
  synthetic oligonucleotide
ccttgacttcatcagaactttttgtgggaaaatttggagtaaaatgtcacaattcaggatttaaacaagaaagacacagctcccacgtatgctgaaaactcatcagcttaagactattcacatgtcctgtcaggattacatgtgttgctaccctttttaaaatttcagtattttagttctagaaagcaggaataaaacccaaaaatgtgtgtaggggtgtgtgtgtgggggtaattcacatgggagggacttgagttgggaaaagggtaggatggggccagcaggctgtcttgaagctgccttcccaaagctagcagttttttatttagatggtgtcactaatgtaaaacaatcgttacattttctaaagatacctttattcatatcttacagaggactgggaaaacatcaaccaaccatatcaatgaatatgatcatttgtattaggtttggttttggtgactttgaaggagggtgtctttctccccaaataaaacaaaaacaaaaacaaaaacaaaaacaaaaacaaaaacgtaatgtgctcttggaaaggtcactggggaccaccaccaaaggaaggggaggggacagcgagaatgaaggagatcaaaagccaaaattaaaggtttttaaaattttaaccaaagggctttattagcacacaagtcagagtcaaggagattacaaagagggcactcctttttgcatccttgaactgtgctttgaatcattttgaaatctcggcttgaatctgagctgatcacttgggggcagacactaaggtagctggcctgttttttagcttaattacccccttgaaccctttctctcctgggcctttgcccttcctttctgatcacttattttgggagccctggaaggaacttgccaataatctgaaactccctttaggagtgagagtcccacaccacttattcattgcccctgtcaatgctcagatgggcccgctccactggcacccttgctattaataggacagtgctaggtaagggagagtgagaggcagggcagcctgttgccacaaggcttgctaaccagatgcctttaatatccctcattgttctccatgcttccatgtgtttagggagaagtgtctggcttgcctacccagcagaactcatgttcagaattttgaacgtattaaaaagtcaagctcaatttaaaaacagctagctcaacgcttttcagatttgtgagataaaaaacaaaccttaaaagaccttgttccaaaatattcttttctttcattttttatttggaaacaaaaccaaatttaaagttgcaagaaatgtacaatgaaccctgatatgcccttaacctagactattttgaacattttgccatattttgtttttttctcccttcatacatacacatctttattatcatcattcttcttc

SEQ ID NO: 10123 - DNA, 553 bp, artificial
  synthetic oligonucleotide
tttctggagatgggaaggtagtcacaaactcctttcaggatccgatgaaagcttagtacctgcttctcagagaaattcacatttatgcatagacacagaatattgcttataatttcataggattcacagactccctgaagccaaactccaatttaaggaacttttcatcagagggggaatatatacttttataaaagaattcctctgaatccaaaaggatttgccatagtcttgcttattgaaaggaaattgattcataaactacattgcctcaggtttatctagaacacttccaaaaacattagtttggttagcttgctcttcaattaggaaaaatttagtttccacttgacttttcaggaattgcattgattaaagtccagatgggctcctttagatctatttctgtgcctgttcaggctgattcttacagacattacatacatcatgtaccaatgccagagaatgtggccaaggcaagtgaaaatatataagccattaagaacatttgtgggtagattggctattggtttaagccattctttcataagca

SEQ ID NO: 10124 - DNA, 1327 bp, artificial
  synthetic oligonucleotide
ttccataaaacgactccaaagttagacctgcctgttggggagaattctatagacagaaggtcaatgttgtccccatccataggggttgaattaccttgctgttaagtggtcttcccccattgggatcctacagtcccacagatgaaagcacagtagtagctgacagctggcttatttggtccctcggcatctctcgtatgtggcatattgcttttgccactttcctatccagcagacatcaaagcaaaactaaaaggtagatatctggaatgaatgtatatgttgtaattgaggcagatatttgccttaattggaaggatctaactgctttacaaatattaaacaagtgcttgggcatgattgggagaggaggcagcttagctggaagctgtgcccatcttactgtcactggagaataggatgtcagagctgggcaggactggtacccatcatttgcagtttgcatgtggggaaaccaaagccctaagaaacaacagttcctggcccaaaaaatccatagaaagaggtaactagtggcagatttggggcgccaacctgattttatggattttgagttagattctctaccctctatcaatactaaaaatagattaggagggtttttttttctgtttatcatgttgaatttcattgacttaattagtctttaaatttgaaaacatgttttagggagtttagttctagaaatttctcttagattgaagtgacagaatctgaaagaaaagaatatgattgagctatttgttttcctgaacacctcaccttttatgatgcaataagttactctgagtttcttggcagagtttttgacagctgttgctttcaatggattccattcctgtattccttatgggaggttgtttttaaaatagactactgcgattgaaatgaactcaatatgtagttaagttatagttttcttcaatgtatttttagttacttgggtcacaaatgttcaatttcagcatattttagggtgagtaatcaaaaatgtgaatttgcctttgatttcctaccactgtctgagctatcataaagcattctctttagttgtgatttgattctatagtctgtttctaaatgacatttgtctgtttcttaaatgatctcacagccatggtaataatagatgtgtactcagaagatcaataaggtaatattggaattcatgtgttttttgcaattaaggcaggcatttgccaatgtcttcttttaagcagtagttggaaacatctcaattacagtgtaacaccttagagctaaaaacatttgttcaacacaaactagaatcacaccttctcactag

SEQ ID NO: 10125 - DNA, 1237 bp, artificial
  synthetic oligonucleotide
atgaatgagaggcttatttgaagggactaaaaatcagtgaagctatttcaggttttattgttaaggcctgccattgattaggcattgtatgggggcttaacatgaaaaataagttttccattaagtgacagtaattgcatgttctctatttaaatacttgcttgggagagacaggtagaactggacattgtctgcagtagcgtgtactctgaccattctcctaactgcacagtggaataactgggcaaactgtaaaaatattgaagcctggatttcactcccagggattctcatgtcatcagtctgggtgtcaggaatgaaagagggagaaactcccaatacttcctggtaatacttctcctatctgcttgaggtgctgtctctggaaagttgaaaatacatctttgctctttgtagaaggagaacctatttccatactccaggaggtctttattgttttagtaaatgctatagcaacttttagaggtttgtgagacctgtttttgtaagtgatgactagcgattctttgtttgaatccaatttgcctcagaaataacattttatagttttaattttttttcctcttttctctttctttttgcttaaaaaacaaaacacaactagctttgaaaagtactatcaatgaagccttaccaaaggacgtgtctgaggatccaggtaggagaaaaccatttttgtatactttatatataattattttaaaataaaaaaacagcaagtcagtgagtagaagattgatacctctgtgatagtgtgtctgtttctctctatttatttgtcttgtattttattacaaggaaaccttttggctttttaccctttctctcttttcaggtatgagaacggggtgatatcttttcaagtttttaagtttcactgaaaggatcacgaaggatcactccgtgtgaatatagggtcttgttactaagtgcaaaattgagaaggcttgaggttgagatgatttcaacaagccattttgggttttgtgtagagtaaggaacttatagggtagatcaattggaggcccagagttggtattttccatttccaaagcagaaatctcaaatatttttattatgcttcaccaccaggaaggcaactatatgtgcttatatatggagtggattccaaggagaaaaataaaagttgtccagttttttggagagtcagacctgtgtctgtggagtcatggagaatggctgcccctgtgtccgc

SEQ ID NO: 10126 - DNA, 938 bp, artificial
  synthetic oligonucleotide
ctattacttttctatttgaaatttctatttgaaatctgccaaatttgttcaaagttttgaacttcgtcttctaaatttttggaaaaattttgcagattttggtaaaaatgaagcagaaattaatttatgtgatttgcatctttcatgagcattatgttattgcttcttttgccctattgtaatttacatatttttaaaaaagctattcatgtgttgcttttggtcccatgattcataattgctttgaggaataaatatgtttgtggttatacagaagagattgctgaatgaaaaaattgtgattcatttgtatataaatgtaaaagctactctagctgagtaattaatggtttatttaaacaatggcacttgacaggttctgtggccaagaacttcttcaccaaatcaaagctttccattccagaactctcctatatatggtaagtacaattaatgccatatgacattcataccatcatccataactcatcctttagttcctacctttgcattttttaaaggcttatgttttgaatgatgtttttaacagactacaggagtgaatacaactcagatttttgttgctgtgaaaattaaatgttatatgaaaagtacaatgaacaatgtctggcacgtattaagcactatgagtgttaactattattttaaagtaatttcctaattattatccccatctcaatcccttttcagtctaggcagttgtgggcacatgagacttaccatcctgtagatttcattttcagacttttctgctaggtgtgatacaagtaaccagaggagcttgacaaactattttttatattttataaggctgagtgaacagaaggttgaggaatattttggagttaggttagatttgactattctagctgcctctgagctttgcaaatttggctggtgtttatcagttgggccct

SEQ ID NO: 10127 - DNA, 2356 bp, artificial
  synthetic oligonucleotide
catttgaaaaatatagtgtgtatgctttaggatagggaggaatggagagagagaggaggacatggaccggggtggaaaaatgtggggtttcgcattgatttttggtgtgagcttgaacaagttttgtactaaaaaaaatgcctgttttactactaaaataagtgcttcctttggagagtgaggatcctctgttactgaggtttgtattttcaggccctagcatataaatctgctacatacgagatattcaactggttttggaggaatgaaggtgaacatggcagtttcctcatctgtaaaagcagggtttggacgaaatgatctgcaaaatgggtctttttgtactcttactactctagtatttacgagtaaccgatgttattccttataaagtctcaactcctggtttgagccatgtctgacgagggggcctaactccaataccaccctgaacactctggggtcagtgggaccctgtttgtacagacgtctgcgtcttccggctctttaggacataagcagtactgctatggaagaaaggaaacctaatttcccatgccttgtccctttctggaaagggcatggcgtggtgtgggcaccacacctgccccagccttctagcaagaaaacaacacaaccttccccgctccccgaaaagagcttctctccagttgggtctagatgcccccttcccaaccagggcggatggccaaaggctccgctcccttgcagggtaggcttggaaaggcacggggcccgccttcctgggcaccggagcctgtgacgggcggagggcgtgcggcgcgctgggttagttacctggcgctgggcggggcaagcgggaggcgggggcggggccggggtgacatctcaggctgtgattgggccgcgccgcgcctgtctccatgtgccgcgcagctgaggcacaacattcaagcccgggggtggggccggcgcgcgccgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggacagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccaggtgggtccctccgcctcctgtccctgcgggtctgtggggcagtgtgtgcgggggcggaggttgcgagtggggcgacagggctgcccccagggacccggaggcctcggccagttctgagagagaggactctgcagccggggatggcggcgacgcccttgtccccgggggacaccagcctccttcgcagctcagctcctcgcccagtgctgggtgcgctctccccatcttccttccctgagacagtctgacactctctcccctcccccggccatttctggggttctgcagccgcccagacccaaagtttgtcctgttctggaagtggtgtttgttttggctgctgcctggtttaacctctgctcgctgctcctgcccctccctctcctgagtgggttctcagggtgccttgctgggatttcaacttgaagggtgtgtgtgtccgtagggttcgaggcccagggctgaatgttgtcctctctatgtagttgtaatatataagtatctactatatgtaattgcccataacatatttctaaatattaatattaaatcgaaaaccttaatgacaagttgcagaacagggacacgggactgcaagaggacgtttgtcaagtcaaaaccaaatttcccatttgagattagaggtggacttcagaagtccaccatgggaaacagctgtagtttcccatctatcattacttggacttgaaatagaattgaaaggtaagggatgtcatagctaccaccttttggctgttctatacttggaaaagtactaggggatgatacataccagacgctgtttttgttttgtgctttccttggagcttggagaaagactacttgataagcctttgtctgtcatttcatgtcaccagcacttcatggtgataagactgttaatatcaggttcaaaacgtgaaatgaagcttttcctaaaagcaatagtatg

SEQ ID NO: 10128 - DNA, 895 bp, artificial
  synthetic oligonucleotide
acaaaaatttaaataaatatttaaaaagagaaataataatgcttgagagaaagaaggcaccacagagcaatgctggtactgtcatcaaaggaaaaaagtcacttgttttttgtggagttgagcaggaaaactaagaccaacaagtaaaaaataacaggtaggtcagtttatcacaggccctttctaaggaacactgtcccaagacggactggaggagcttaaaaatccctctggactcaaatttaattattccagttttccccaacttgatcatcatatgaggacttttctttttactagaaatcccttcacctccatcattaaaacacagcctgttttcctaaactaatcaatatgacactattttcctccaatactggatgtacctaaaggctgcagaaggactaatggttaagaaagcctattcattttcagtgcagaatcctttgaccccagtaactaccactaggaaatttagccaagcatcacataaatctggcctattgcaagattattctcagcagtattgtttatagaaggaaaaagactgaaaataactaagtatccatcagcaaggaactggtatcatacattacacagtgtatccataaacaaaattctatggcactcttgaaaagaacaagcatatccaagcatgctgacaggaaaatctccaatacatactcttactgacaaactcaagtgaagaacttgctaccataaaaaatgaagatacaggtatgcacttctacacgctggcaaggatgggttaggaaattgaaaacaatgactggggaaaggaagtaggacagtaagggatgtggaaaggggacttattcttcactctatgtccttttatacttcctgaatttgaaaaattacaaagctttttagg

SEQ ID NO: 10129 - DNA, 303 bp, artificial
  synthetic oligonucleotide
ttctagccataactgtaagatttttactgtacttcctaaatacaaagtgcttatgaattttagctggaggagagcaggagtgttcagaagcaaatgaagatcctgcagaagaagcaagcccagattgtgaaagagaaagttcacttgcagagtgaacatagcaaggctatcttggcaagaagcaagctagaatctctttgcagagaacttcagcgtcacaataagacgttaaaggttagttgcttcatttgtctgtttttttcaggagggacttatctgatttcataatcaaccctgtgccta

SEQ ID NO: 10130 - DNA, 1133 bp, artificial
  synthetic oligonucleotide
aaccacagattctttttattctttacagactatttatttaactttgcatctgctgccacaaaaaagataactgaatcagttgctgaaacagcacaaacaataaagaaatccgtagaagaaggaaaaatagatggcatcattgacaaggtatattcaattatcttttggaagtagaaatgtatgaaattcattgtttcctcttgatggtttcttcttcttatgaacattttttaacctaagtagaatatcatattctgataaaaatgttaattgttgagatttttggttttttcctctctttgaataacaagtaagtatcattaaattacagtacttgatttaaatagctgtttttattttaatatattacaatcaatacattgatacttgggggttatactaaacttttcatgttggttgtttgtttgtttgtttgtttgttttgagatggagtctcattctgtcacccaggctggagtgtggtggtgtgatctcagcttactgcaacctctgcctcctgggtttatgcaactctcctgcctcaacctcccaagtagctgggattacaggcatgcgctaccacacccagctaatttttgtatttttagtatagacggggtttcaccatgttggccaagctggtctcgaactcctggcctcaagtgatccacccgccttgccctcccaaagtgctgggattacaggcatgagccaccacgcctggccaacttttcatgttgtgagtttaactttataactgtttgaggatatatttatgcctttgcatcatgcgactaaggtcctagcccattaggaacaacccttttaagactctaaggagtgagtttgttttttgcagtgggcctatggcatttcatttatgttggtagatatttgaactaaggaagtcatcaattaaaccttagatacattgctatttaatttgactatgtattttttttaacagacaattataggagattttcagaaggaacagaaaaaatttgttgaagagcaacatacaaagaagtcaggtatggtataggtttgtcttaattaacctgccaggttttattgagcacctgttatgtgctagataccacactgagggtctgagaacacaaaaatgcata

SEQ ID NO: 10131 - DNA, 426 bp, artificial
  synthetic oligonucleotide
caccagactttataactaaaactgtctaaaaatacacactattggcttgagagtaattttaaaaatagaaattaagatttcaaaagcacaagtcatatatgcaaagtggctttgcagttatcagaaagtgtgattagcagggctactctaatatgtgagatcacccaaggttaccattgattaataaagatttaggcaaggctggaatcaataggtcagttgtaacggctattccagtgttgttactgagttaccatatgatttatggttcctagatcaataaagatgaagtgagtctttaaatttttaggcaagtgtgtatgtgaaaagaagctaaaacaggaccagctttgaaaaaaatcaagagaagtgtttattcaaggacagtttttttcctagagtgattttattggatcaatgtgatac

SEQ ID NO: 10132 - DNA, 1156 bp, artificial
  synthetic oligonucleotide
ggggtggaaggagagaaatatgtaaactatcaggagacctggtttccgaccatcactcaacattagtttactgtaacagtctctttctctctttttagtggcttgacacaacaatgatttatttagctttcaattctgtgagtcagaaatttgggttggacttaggtggtggttctcagtgagtctcagttggacccattcatgcatctatagttagtgattgggatagctgagggacgtttggtgtttataacctcagatgtgatcgcttgctattacttcatgtggcctctcatcctccagcaggctagcctgtgttcaaccacaaggtggtggcaaaattaagcatgctaggattcttgagacctaggttatagctggcacaaggctatttctagtgcatttttctggggaaaaaatgtcataaaggccagaataaatagagagttagtctctacattttaatgggaagagcatcaaggtcttatttcaagcaagtgtggatacagtgatgcagaatgtgtgtacattttcacaatttgtcatactctataagagaagtattaaaattaggtttatgtgaagataaataagacaaggtctttgcattccagaagctctataatatgattaaaagatattgcatgtcgtagaaactgggatgacaaaaatgcaataagaatgtagataaaaataaatattgtactgtgacagtctcttaacctctgtgcatctcagttttctcagctatgaaggggtgggggaatctatttgaaattttaaaaatatctgatttcagatagcaaaaattcttattcagaaattgcatggaactagaatggtattaagagcatgaaatctgtgccagattgcctgagtttgaaaccaggctttagcattgactaattgtgtcatcttgggtgaattataaaacctcgctggagcttggtttcctcattcttaaaatgggattaataatagtaccttcctaatagggttcaaaatctaaagagctataaagcatttagaatagtgcctggcacatagtgaatactcagcaaatgctaattctaactcctacccttctacaaatacatgttctcacatacaaacactcttgaataaacctggattttggagtgagaatttaaggggt

SEQ ID NO: 10133 - DNA, 1151 bp, artificial
  synthetic oligonucleotide
tgctgtcaatccttggaataagaatatggataggctgagctaagagagcttatacaatggaatggtttgactttctgatcgcctatactaccactgctcctggttcatatctctagtgagagagaagtgaagcactgaataagaagacatcactaataattaaagaatcaaagtgtcaacaaaatgatggattcttcatgtatttctgaaaggatacaaaacaaaaaacaccattatgactcctttctaaggcatgtaacaactctcctttatgtggcttttggaatttacctatttatgacatgagatccagcttcctctcctgaacctaagggtcataaagactctcttccttgttgaccataaggcagtttccggctggcatcttactttctttttgaatataaaataaattcttaagtgtcaatgtttgcaggaacaaggatgagttattcctagcctctgattggtaaaaatttcccttctttttatctgcaataaagtttttatagatgacaaagtctgatttttaaattctgagctacaatagcagcatgtataaaattatgctacaattatgtgcttatatatctgtctctcccactaaattgggaactccctaaaggttggagttgtttgtcattcttttatatattgaaatgcatataacagtgcctgcacctaagaaattgctaacaaatggtttttccatataaattcattcattcattcatttattcacattgttcagtctccctggattttactttccctactttttattagaataacagtataactagcacctggcaaattgtcagacacatagtagatactcaataaatgatatgacattccttctccctattcagagatgcaatccatcaaacctgaagaagtagatgttatttagagtagttgagtattctgggatgatgttctcatccattttagcttcaagtttaccctcctatacatttctgtccttggccaaggatcataaggaaaaggcttcctgggatgtcctgctttctctgtcttacatgaacatgatttgtgtacagactgcaagccttgttactcttgcttggtgaacatagctgtaagtaacccctaaccttccagacatgatttgttctggtccaagcccc

SEQ ID NO: 10134 - DNA, 2050 bp, artificial
  synthetic oligonucleotide
attgtttaataacttacttaacttaggctttatgctctctagatataaacaatgaattcttttccttttataaaaaaatatgctgcatgttttattaaaagaatatgcaatagttaccaatattaaaggttttaaaattcagaaatataatgccacagttaacaaagtatcaagtatttaaatgaggacttaatatattagaatgccatcactagtaaaatataagtatttaggtattaaaactgaatgaatattagaatttttgaactatataaactcagcattaatgctttgaaagagttattattcagcaacagatattgcagaacagacttcagacatagctctctaataagttcttaaagggattgtttgatattattatatagcacaaatgtgattcaataaatgtggcactacaaaatttcttaatactgaatgttttaaccttaaatattatataatggtacaaattaattttagtttcttgtaatattttcacatatacttttatgtgatacattagaacacattagctcatacagattgtaagataatcacacaaaatagtttctttttttaacctccatatttgaagaccaaactacactatatattatggcactgcttattttgacctagcacttcagctatattttctttggtaaacattttaatgattgtcatgttttcctcttataagataaatcacagatggttcattaataatatgtatgtgtttaagatttaatattactcaaaacacttctaggtcatattttgtcaagatgagattaaatcagttgcagaaaggaatgagctgtatcaagatcacatatagaatgaaaataaaacagaaaagtttggaatgtgaacaggaaaaaaatacaatcataaaagtactagttctaaaatgttctactattattatacaagacaataaatcaccatgctgaggatattttctttcatatgtatatcagcattctatttcctctgtgaaattctgcatactcgatgagtagtcatttagtacacagggacattaaaatattcatgacgtggctacaaaagaaatgcatatattcttacacacagtatacaaactgacacagacacaatcagatttctagaacatttagctcacagtaaagataactaaaacttaagtttctgtttgctttcattctttggtttaaggctgaatatttaacttctaaacaatgcccaagactttagattcatttttttctaactttactacatacagtgttcaaaatgatgacagacatcctccagaaattttacaaaatcctaaaacactatatttactactaatattatgaaaagattttcagtgtaagtcatctggtcaatactgagttgaccaaaaattcaattagaatattccccttccaccagtatttaaattcattagttcatttgtattacataaactaaagaacctagagaaaaatctttcccaataaaaactggaaaagtagtcactcatctggtattttaagtagcaatgaaggtttttaaccgtttacttatacctacaaaagcaaaaaatccaaagaatttgactgagactgaggatattacttttttaaaaatcctcaagacagattttaacgaactctccagatttgagtgtctacagaaggacttctaggggctctgagagttccctgaaattagaaacaaaatgatgtgcaaattttcctggggtgacagcccatcatccttcagactctcaaagggattatatccccaccagaaagcaagtttaaaattgcttatttgagtgtctttaaagtatcctcattttaatatttattcaagttgaaactttgaaatgttgaactacaaaatcatgtaaactgttccaagaaaaatatctaacaaatccctaaacttacacaaccattaattacaaacgtatctgaggacaaaagccagttacattttaatcctcaaagaattcctaaatattttaaagagatagctgcccttttcccccaactcagaatatagtggaatgaag

SEQ ID NO: 10135 - DNA, 2503 bp, artificial
  synthetic oligonucleotide
tacaaaaaaacacatcactaatgtcccaggaggaattcagaatacagaatgccagtcggttcacatgttcctgattaaagaatgaaagcatgtcattgccttcaaaccagaaaatgaagttcaggccaagtttccttgccaacctccacttaaatggactgctgggtcaatcaagattctccattccaaacgtaaactgaccaaggcccacatctagattttaggccactccctagcacactggcacaccactgaattcagtgcttgtcaagaatcaattgtttgttcacacatctgtttgatgtcagttgtacttgttatcgtcgtgttgagtaatttaattatcatataaactgacaaaaagagtatccacaaaaactaagctgaacagtttgaaaaatccaataaaggaatgtcacagaaaaaagttcttggcagatgaggggtgtcctaaactactgtataaaattgaaaacaaattaaaactcctgaagcatatcagttcatacgcctttaagttctgaccccacccaaaagaaactcaaagtagcaatggtagattatgttttatgaaggagggtgtgcaagatgcagctgaaaccagtggcccagcactcaaagcctgcaatcctacatcaaactacgggcaactcagtgtgtattaatattttgagtttaattcaaatattaactatttaagggggtatgtatttatgtattttttttaatgattccctactataaatgacacttttgattagtggacaggttttcaaatagcactcagaagacactgttttttataaccagactgtgtcagacttttagtaaacaagcctccacacattcaactgcagtgtccattaagtgctgtagaggtacaaaaaacagcctccttggccaggtgcagtggctcacgcctgttaatcccagcattttgggaggccggggcaggtggatcacgaggtcaggagtttgagaccagcctggccaacatagtgaaaccttgtctctactaaaaatacaaaaaattagctgggcttggtggtgggcgcctgtaatcccagctacttgggaggctgaggcaggagaatcgcttgaacctgggaggcagaggttgcagtgagctgagatcacgtcactgcactccagcccggggggtgacagtgcgagactccgtctcaaaaaaaaaaaacccaaaaacctccttgataatagtggacagttacaaactaggctaatagtttataggaactatcactgaacccttgcgaggttcccaatgttgcttacattacacaaatgaaaaaactgagacttagagatgttaagctacttgtcctcgatcacacagcaggacagacccatcatctgatcccaggacatctaatccccttttcttcatcacttacctgccaatatgttactaatgtcttatacatgatgaaatgaaacaagcaagctacaatacagtaacgtgcagagcaagcccactgattttcagtatatgtacgtacacataaaaaagacaggaaagctataaatcaaaatactcattagggtatctctgaataatacagttacagctgattttagttttcatctttgtgcttttcttagtttccaaaatatctgcaatgaaaagacattactttggcaatcagaagaaaaaagccatctgtgagctctgccctttacttcttttttttttctttagagacggagtctcgttatgtcgcccaggctggagtgcagtggcacgatctctgctcactgcaagctccgcctcccaggttcatgccattctcctgcctcagcctccggagtagctgggactacaggagcctgccaccatgcccagctaattttttgtatttttagttgagacagggtttcaccatgttagccaggatggtctcaacctcctgaccccgtgatctgcctgcctcagcctcccaaagtgctgagattacaggtgtgagccaccgtacacggcctgccctctacttctttaccacatgtgcagggctgttttaatttttaaaaagatctgaaatttaacagcatcaggttattcttatttttagtaaccattaaaacatcaaaggttgggggacagcattcaccaccatcctgaaaaatcgctcttcttggatatataaaccaatattagaactttctttgctataatttatagcattataaaaccataaaacaaaatgaaaagccaaacaatcattatatacaagtattcaacagctttctatagggaaaaaagtctacaatgcaattatagctatcatttcattaccttttctgtaaacaagtctgctgacaacaacaatagttatactatcatgccttctaaatgggtctggagtgaagtcagtaggatctacagcattaggaatgacggacactatttcaggattcagtgctgctcttagtacagtattttccttactagtataagacacacaaatgatgtggtttgtatcacaaa

SEQ ID NO: 10136 - DNA, 611 bp, artificial
  synthetic oligonucleotide
cctagcctgcctgcagagggtataggttttttatttctcttgtctattcccttgtatcagagacctatggttttcaggaatgcgatgaattggtacattaagtctgatttattgtagagatatgcgttaagaagtccacgtgtccacaaatataagccacattctccaatatcctaaatattggttttccctgtggctctaaatcccaagtggcaaagagggatgctattagggcttcttgaacctccacaaatgaaggctattcaactagaaagaaccaccagaatcttacccataaactgcagctcactccagaaaggtactggtgataaacagagagacttaataattgcttaggaatagggtgagtttttaaaatgagaccaataaaagagggtgcatttccaagaatttaacaaagacgtagccagaaatctagacactgaccccaggtgaccagacatacaattgtttatgtaattagagtacacaggaggaatacactggaatattggaaacatgaggggatagaaaaaaagactgctgtttggaacagaatgtctttataggacatctatttcactgaaagggacagcgttttctggctattt

SEQ ID NO: 10137 - DNA, 1414 bp, artificial
  synthetic oligonucleotide
aagtaataaacttaacagttctaaatacttggcattgacagcagtcaatacatataataagtttacatttctgtaggaagcccagcatacatttaagctgatgatggaaggggaattccctttccctgttcactgatataacatctgaccctatcaacctggtatctcctaattttcaatgtcataaagcctttagatgtaaaggtgggaggacttagaaaatcaaacaacctatcccacctccatgaactgaagtaaataacacaatttaatttgtatttgttagttagtggttcactcaattcaacaagccttctagacagatagacatatatatagatatgtgtgtgtgtacaaaatttctgtcttctttctgtccattcatcaatccatccatctatccatcccagacaatgagctaggcactgaagagccaagaaacaagcaaaaaaactggtagctgtccttatccctttgttcccttcctcacattttgcatgcaatttcaggaataagagggagagtaaattctgaatggaaacacaaatattttacacaaagtgtttcagagcattctatttcctgttttaagagccactgtttaaagttcaggtgaaagaacaaaaaggacttgattcgctttcaaacttcatgatgttccacccctcaaaacctttagctcatgcttttaattgtgcctagaataatcttctatgaaccactgatttgcctggctaacagttattcatgtcccaagattctgtccaccctgagtccctctcctgtgctgcaatggtcctctcttatagcacatttcacctaatattagaatcattatttaagtgttctttctctacctgtagatgaaggcaacgaccttgtctgacttgattttatgtctcctgtgcttctctcaacacttggcacataataggtgcccaatatatatttgctgtttggaacaagcttgctggcaagttggagatcaagacatgcaaacatgagaatgtcatcagaattttctgcctgttcttctgttttatatacatgtgccctctttccttatctggatttaaaagtacttgagtggcagagcctacatgtaatatttgatgtattcaatttcttccttctgtgtctcttgccagtatctagaaagacactgaacaaatttgtggactgcattttttaaatgagaccacctggttgtaaatgttttcttttcccaatcatatccacagttgaatacttttattgccttaaagcaaatacctttcattgtataatgaaacagactgttcaaggctctttctcactcagtggtccaagcctttattcatactcagttttgaatttcaacaggttcccagaaacaactgccaatgttccctcctgggatatagcaatccttcag

SEQ ID NO: 10138 - DNA, 474 bp, artificial
  synthetic oligonucleotide
tagattgcctatgtcctattagaatttggccccatacagtagtagtatatatattccagctccaagaggaaatatagattatactgcctagcatccagtttcatatggttgatgaatgaatcccgtcaaattctacatttttcaaatagtctctatacattttctgtcatgctgaaattgtatgaggacatatttaaatgcattataaaatttgttctctgaaaagaatgagaaataaatattatgatgctttagagctaaagtagtgctggaaaaagttactaaagcccttcagatgttagctttgcaggtcttcatattgaggatgatgaacctttgattttaaagacaaattgtgataaaagaatcctatactgctataaaactgatggcgcctatcaaagcattgagaatttacattttgtaaaatacccatgagggcaacttaggacctaactagtaaagaaggaggtt

SEQ ID NO: 10139 - DNA, 1008 bp, artificial
  synthetic oligonucleotide
tgcagatcagctgttaactctttccttctcacttgcatagatatgtcatgtggggagctagctaatgaagtacactatttagagggtggactcttggtgatgggggaagaacaagagaaacaaatttctaagaagtttctgtggaaaacagcttaccgtagtctaacaaaacacaccctgtaaatgtagcatctgaaagaagataggcatgcaataaacattcatcaaatacacaaaaatgcaaatcttctatagggcaaacagcttagaacacgaattgactcacaacacacccctgcatcatcttgaagacattaatgattaacccactttcacactggtgggattaatcctgtgtgggattaatctagcacagtaaaaaaatgcagggtattccctgacctccaattggctgagtccagttgttagaactgctggtgtgatcactggtaataaatggctttatgtttattctcactttaaaaagccactttgacattcagctttgcaaaatgaattcagacgtttaatgctccattgagaattagtggatttgtttcatgttcaaaacccatgaacaaaacagagcttattctagaaaccaattattcaacattctgaagctctccagagcaccagagcgcatataaaagaaataccttggccaagcatggcggctcatgcctgtaagcccagcatttcgggaggttgaagcaggtggactgcttaagccccggagttcgagaccacactgggcaacatggtcaaaccccatctctacaacaaatacaaaaaaattaaccaggcatgatggcacatgcctgtagtcccagctacttgggaggctgaggtgggaggatcacctaagcccagggaagtcgaagctgcagtgagctatgattgcaccactgcacaacaacctaggcaacagagtgagaccctgtcttaaggaaaaaaataaaagagagagagagagagagagatacctgaataggtaccatttagaac

SEQ ID NO: 10140 - DNA, 908 bp, artificial
  synthetic oligonucleotide
atattcttaactggtttttgatgatctcagttgcacaaatatgtacataagtcaccacactgctgtaagcaggaggaataatgtatatatcacttaatacttcttgactttcaagagaatatacacaaaatttggtattccaaattgcataatctgattttgaaggctcttgagtacattcttcctcagataaacaacattcctttagtcccaataaaaccatacctaaattttcaatctcccctgcccactgaatagaggaaaagttacctgacacactaacaactttgccagtttgagaagagataaagaagaatgctttgacatgcctccataaaattaaagggccattaaggacccttaggccatccttcatctcatagcctagtttaaaactcaaacgcatttcaaatttattagtactgtgaaggattagtaaaaaatattcaaaaacattattctttttatttttttctatcacaatgtaagggaggttaattccagttctgaaatctgacacacagttgcaacacatgatttttaaatgagagttttcttcctttatggtaaaaaatccagtggacttctgaacaaatacttttgttcctctgtcaaataccattcttctgacatgtaatatgggtgtttttgtaggctctttatctgcaaaatttcctttagacaactggaaaacaaggacttccccattataacacaagagcctttcttgttcgttagatgacattgcttgtttgctagtcattccacaatatcaagtctttgtgctgatctaattttcaaatgcaaattgattccagttgatgtttctaaacctaaaaaagaaatgaggaaaaactgccatgaagtaggaagggttgaaaagaaaacacgtttctgttagagaacta

SEQ ID NO: 10141 - DNA, 601 bp, artificial
  synthetic oligonucleotide
tttagagatggacatcggaactcatctagaccagtggtttccaacattttacattagagtcactggatctttaaaaaaaatagaccctaagttctcatccccagagactggtctagaaagggctgggaggggaggcaggcatacatgtatttgtaaaagttccccagcagccagagctgaaacccacagatcccagctcagccttgacattattggcatgaggtccctgaggctttgaaagaataagtagcttgcctaaggtcaacacagcttataagccttggagcaggcacagaacagaaatatccaaattcccagagcggatctctctttactaaaccaactggcatcatttctacttcacactggttgagatctaattaccaattagtagtagttgggaagtccaagactgcctataacaagtcccctcctcctaatgacctgtatgtgcttccttttcttgctaagcactgagtaagtcttcagatagttatgaggacactgatgacactgtaataattaatatatccagttattccacattttgaaaggcttcacttatttaaaacttttgcatccataaaatattcatattttt

SEQ ID NO: 10142 - DNA, 292 bp, artificial
  synthetic oligonucleotide
aaaacaatctaatagtatgtccgaagaccctatatgcccccacaccagacttcattgtgcccattatatacctttactgaaaatctattcatctgccattctcatgccaaccagaataacacactgtattttgaaacacaaaacacatatgataagtttgtctgtgagaaaaagttgtgttttacgctaccatggagtaaattttacctcttttaaaatctgcaatttaataaaccttttggagttcctatgactaaagaattatcttagactttgtgagatggtgatggat

SEQ ID NO: 10143 - DNA, 2197 bp, artificial
  synthetic oligonucleotide
gattctatgtctggagaaagaactgggcaagctggacctggaactctttttgtaccagaaggcagaggatgctatagaaaactattctgtgtaaaaaggacactgaactaagttgggaaagtttgagtatcaaaaagaaatatgatgacaattaactgaaatacatgaattcagagagttaaaaattattgtctctggagattgcaccaacaaattaagctgaaaattgataaataaattatcaattctttttattcttcctttcctgtataaatggtatgtgagggtaaataatagctcatgaaaggaactttctctccatagagaaattctatctaattaatgtagaacagaattagaaaatcactagctttgcaaccattagagaaataatcaatgtagccaaccaccattaataaatatcaaatcattaggtgaaagggtgataacatctttaaatttttttaatttttaatttttgtgggtatatagtaagtgtatatatttatgaggtacatgagatgttttgatataagcatgcaatgtgaaataatcacatcatggagaatggggtatccatctcctcaagcatttatcatttgtgttgcaaacaatccagttacactcttttagttatttttaaatgtgcaattaagttactattgactatagtcaccctgttgtgctatcaaatggtagatcttattcattctttctatttctttgtacccattaaccatccccaccccctccctcagtctcctactatccttcccatcctctggcaaccgtccttctattctctatctccatgggtttaattgttttgatttttagattccacaaataaatgagaacatgtgatgtttgtatttctgtgcctggcttatttaacttaacatagtgacctccagttccatccatgctgttgcaaatgacaggatatcattctttttaatggctgaatagtactccattatgtataagtaccacattttccttattcattcattgttgatggacacttaggttgcttccaaatcttagctactgtgaatagtgctgcaacaaatgtgggagtgcagatagctcttcaatatactgatttattttcttttggatacatgctgtcattgctgggtcatatggttgctcaattttttggttttttggtaacctccaaactattctccatagtggttgtactaatgtacattcccaccaacaatgtatgagggttcccttttctctgcatcctcaccagcatttgttattgcctgtcttttggatatcagccattttaactggggtgagatgatatcttattgcagctttgatttgcatttgtctgatcaataatgttgaacacgttttcttatgcctgtttgtcatttgtatatcttttgagaaatgtctattcaaaattttcacccattttttgatcagattcttagattgtttcatgtagggttgtttgagctccttatatatcctggttattaatcccttgtcaggtgggtagtttgcaaatatttccttccattttatggattgtctcttcactttcctgattgtatcctttgctgtgcaaaacctttttaatttgacattatcccatttgtccattttttctttggttgcctgtgtttgtggggtattactcaagaaatctttgccaactccaatgtcctggtgattttccccagtgctttcttgtagtactatagtttgaagccttagatttaagtctttaatcaaatttgatttgatttttgtgtatggcaagagatataggtctagtttcactcttctgcatgtggatattcagttctcccagcaccatttattgaagagactgtctttttctccagtgtatgttcctggaaacttggctgaaaatcagttcactgtaggtgtgtggatttgtttctgggttctctatcctgtttcattggtccatgtgtctgtttttatgacagtattatgctgtatttataacatcttaatggaaggattaggctgatagcctgtgaaccccgtgatcattttcacatcattaaaattgaacaatcagacattgggtgcctcatcatataatccagttgctcctgaattgaatcaaacctcaaaatcgatctaccaatttatgaaaaataaatactttatggaagagaggaacaagttaaatgatactatg

SEQ ID NO: 10144 - DNA, 394 bp, artificial
  synthetic oligonucleotide
ttgtctaacatcaagtttgccacattatacagggcatctaataaatatttggcaagaatgattctgattatgctattcaattcaattcagcaggtttttattgagtaccgactgtgtgctaggcatattttaggtgttggagattcagtagagaacattaacagacaaaaatctctgctctcaaagaggtgaggagtaatcattaatagttgcatagctattagacggagaaagctgggatttgggataggccttctcctctgagactctggctctcagccactactctgaacatcctaggcctgagtgtagtcaaatgtgcagaacctttgcccaagaagctaatgcttaatatgctgtaatttttttttatctccatttggtagtatggaaa

SEQ ID NO: 10145 - DNA, 1932 bp, artificial
  synthetic oligonucleotide
attaactcgcaatggttaaacccactgacgtcctcgttaggaatgctcttcacagtctttgtggcttgtggctggagtctgtcactagagaaagataacggagcaggaggagaaaaaccctttcccaagcacagctgtcacacgttttcaggagtgctgcggaatgaggctgatttccacagcactctttacgagttttcctcccaatacagagtccccacttaaagacatgttgctgacggcagcatttcagggtgttaggaagtgacaaaaagaatcctacagccgccttacaccagcctcgggccaggttggagatttcagattttaaccctccggagctgagccttttgccgttgctagtcgttcccccgttgcattggaacccgctcagcacaccgcctccacctgcacccgggccgcattttaatagttggaacaagggacaaagaggagagactcagcctccgtcccatgctgtccagagtctctcctgtcactttcctggtttcaagggtcatggtttcgaaatgagctcccggaagaccccaggcttggggaaccgggtgtttgtttcgcgcgggcttaaggagaacagaagcacggcggggcggggcggggcaggactggactgggagctcgggcgacagggagagcgtcccgggaaacaggcaagaagcgactctctactggccccttaaaataaagcactagcccgggacgcgccgtctgttctctctgcaacccctcccgggtacccagctcttaggctcccgcgagccgcacgtgcgggggtgcagcctggccgcagccggagcggggaccaccccccccacaggatacaacagggaagcgcacctgggcgttccggacacctgcgccgcgcccctcccacctccagcgtcccggcttcgtcgcagaggtggccgaggaggcgccacctgagcgggggaggggcgggaccctcggaagggcgcgccctcccggggcgggggcgcgagaccgtggccgtggcgcgcagccagcgcgctcgcttacccatggctggagactggcgggaggggtgagggctgcggggcgttcgggctccccggggacgggcagagccggtggcacaagtttgcaggtctcgcgggcacgtgcgctgaccgggcttctgcgggctgcgctgcgctgcgcggggctggccgctggctcctagctcccggccggggtgggagcgcggcgcggctccgcctgcactgggggccggccgcgcggagaggggccctgacgtcagcgccgggggctttgtgcgcccggagctagggcccgattgggggcagcgggcgcgcggagtctgcaggcaaagctcgcggcttcctctgggacccccccgggcgagcgccgagggtcgcgggaaccggaaaagccagcgagggggatgggtagagaggggagtgggcttctaggatcgcggaggcggcgatccgcgtcccagatgaaaactattatggcctggggaggttggggggagcggggggctttgaggtcttagccacacccgttgtatagataaagaaactgaggcccgggacactggaccaagggcacttagtacttagcgttgcctcaatccacagtctcagttccttttgttcagatacgagtcgttacttaattcagtggtctcaaccctggctgcagaggagaaatcagctggggagcttctggaaaccggatttcatcatggcctctgcgggtgggacccaggcatccgttctttaaaagctccccaggtgattccaatgtgcatccaaggttgcgaaacattgacataagtaacttgtcggtggctaatgacttagaaagacacaggtagcaccctccaatctagagtggtgccagatttgctggtgtccgttatcacccctcttgattcctggaagtcca

SEQ ID NO: 10146 - DNA, 796 bp, artificial
  synthetic oligonucleotide
tcagagtcaacacatttttaaaccaccttaattgacccaacacactttttctcccttctgtgaatggatcagtattatccaggtgacatttacttactgtcataatatcttccaagacagactgtggttaaactcacaaatacctcccaggagcaaattgcatcttaataaatttcatttaacctgagagtaaaattatacttgacagaaaaaaagctctcaaacaacccttcttcagatgagctacttttatctcttgctactgttttaaattattcatatacaaactgactatattaacacattaaataatccagatgctgccacatgtacatcccatgaaacaggaatggtttgttaataagcatacctagatctacgcatcaatctatctgttactctctggaggggaaaatcctccacagtgaattcttgattatttctgttgtttgaaagaatcttcaatctgtggataatattgcactacttccctacccagctgcaagtcatattcagaaggccaaaggaatgtcccaagtttgttccaaaaatgtccagatgggctcgctcgaacaccactccaataaacagtgccagccaggcgtacacagcctggtcagcccacccaattcctgcccaataagggacaggcattcccatccttcaaccagcagggtctcctttgctacatgtaaatctcctctgacagctcatgactccaaaagtgttttccttttaatctgcttaactgcatttctttatattacaattaacttacttccccatatcagttaga

SEQ ID NO: 10147 - DNA, 891 bp, artificial
  synthetic oligonucleotide
atttgtccggaaacacaggcaggaatataaagaacttaaatatacagtgttttccttaagtggctagttattttgcaatatattgttcgagaaaatctccctgaaaaattgctgcttccttttgggggtgttagctcaggctttccccttgtgttttccaaaaaattccatgttcaagaagctgaactttcttgctccacataaaagcttcgggatatgcttaacctcctccatcttctgaactgcgtctgacattcaaatattccctgtcctactacaggaagatcttcacttactgcttctaattggatttgtaaggatgaacttgtctattttcccctttagtccagccatgaggctaagatgaatggcccctcataaattgctggtctggtcatttatctgcaacacgtgcgagttattatcccataataacacagataatgaaactgagtggtataaaaccagcatcgagtggggaggctcattaaaagaatgactttgttacatgtgtcttgaacctgtggaatttctgctcggccccttcagttctgaggcacccctgcccaggctcgcacctggcccctagtgcatgctactctgcccctctgggggaccacaagctccctgttagtggtagtcttttattctggcatggccctcctttttcataaacctggggccttttaggcgggacctggctttttttttttttccctgccccaaggtatagaaggaagagttggccttcttccagtctactcagcctctagactgtgctgtccaatatggtggacatgaactgcatgtggctttgaaatacttttgaaatgtggctagtccaaatggagatgagcagtaagtgtaaaattcataccaaattccaaagac

SEQ ID NO: 10148 - DNA, 445 bp, artificial
  synthetic oligonucleotide
aacttaacattgttattacaagaataatgcatatttatttgtttcaaataaatcaaacagtatagaatggactgaaagagaaagggaaagttcctctttcaactcattttccagagatagctactgtgaacagttttatgtgaatcattccagatgttttctaataatagtgttagtggcaagagctgcttgtgaaagtttttggaaaattgagagccggttgttaaacgaagtcactattaaatgatataaacttacaataaaataaattatatgaaaagtaaaggtaataaatgcttaaaatgcatcaccgcctaattattttacacattttactattactatgctcttagggttacttacatctactatatctgtatggtggaaatactataaaatgctggctgcaggcatctcttcccaactcctcttgacgactttacac

SEQ ID NO: 10149 - DNA, 1433 bp, artificial
  synthetic oligonucleotide
aaaaggcaccctgcaagatcttttctgtgtttcaacgatgaagtagactcccaacatggaacaggggcgggggggctgttaccagacaggtgacatttggtgcatgcacgaacaggtccagtgccccattcggaggccaggaaggcagccacccagcagagcattaactaggggaccagacggtcacctgcccctgctcacccccacctccttcctccccaggaaaaaggaagtcaagtagatggagaaacggggaagtccaagctgctggcagtggcattcaagggtctatatataaggttgactctaatccccagcgagacaaaagcctgtgccataaaaatgattagcaaggggtttctaaaaacatttccccaggccacggaaaaggagaaggaatattttgcacactgccttgtctcttagaaataatcacagctaggcctctttataaccggcgagtctttttcctttcacacgccatttgcaggcgcgtggcatggtatttgtaactaattttcagtagcaagtgggtcactggtattcacagagtcaggtgccattttgaaaactgcttccctctacccgaatctcttatatttccagatgcagatgcacttcagcgatgtcctagtgctggaaacgctcccttgaaaatataatttgatttttgaatttcatcttaagacattagagataatgtaactgtagtctttggaattcaacgctggcctccttagccatcacttttaaaatttatgaaaataaggaagaggaaggtaaagaacttcctcattgtccggcagtaaagtcaatggcagagcttgagcttgacttattttgctaagagggaggtgttttaccctataaactccaaattaccttacacccagcaaatactactgttgagtgctcacaaaaattatgctgatgaaacaatatggatgtttcagtgatgaaactttctcttttaaaatcacttaagggtgctttacgtcccacccaaggcaagaggaacgccagcgaggaagacaaagaggcccggggtggggcgcatgcccgccactggactgaaagctgagtcacaggaatcgtacccctgcagcgggccaggccctccagggagggacaccgcgcccttgtgtggagatgtccacagtagacaaaggcagtttcgaaataaaagaatgcctgtcaccccaggtgccaccccgacccttagttattatgcactggtccccaagagcaatttctgcgctgctgttgcaaaaattcatcgtaatgaaataaacgtaaaaggggaaaatgtgttatgaagtgttggagggtgctttgctcatttttttcgccatcgttgtggttagggtgcatgcactagtggaccccgggtgggggtggggctcccctccccaaaagcccggcaggcctccgga

SEQ ID NO: 10150 - DNA, 950 bp, artificial
  synthetic oligonucleotide
gaacatgattgaggagactcaaacagagatgtgcttcagacaacaccaagacagaaaattaatccattttaccaagttaacaatgtactgaaggcgaacaagagaccaacccacctgccaaccaacgctatgaagaaggagggttgatcagtctggctaacatggtgaaaccccatctctactaaatatacaaaattagctgggcgtggtggcacactcctgtaatcccagctactcgggaggctgaggcaggagaatcgcttgaacctgggaggcagaggttgcagtgagctaggatcaagccactgcactccagcctgggtgagagagtgagacttggtctccaaaaaaaaaaaaaaaagaaggagggttaaaaagagaataagtcccaaactcataagatggtgtggaaagggccctggtgacataggggccacccatgccagtgagaatgaaatcacaacagggcagtttcacactgtttcaggtttttattttttcttcttcttctttccctcctttcttcttttgcctccccctccctctcggtttcctttttggctctagacacccacagcaagtgtcaagcaatgtacaagaatgaaaagaagacagccgttgttgcaggtggatgcttctgtttggaaggtgtggttttgtgtgcacttttggttggaaacctatgtctctctcacacacatgtcccccacctgcttcagtgagcatgatcttctaaaattggctccatggaatcttccctaggtgacactggctggactctgacacattcaaattcattctttctacttatctcaactttcaagcactaattcagtctttaagattcccctaatctcaggttgtaattcatttctaacatgtttgtcatgacatcagtggttgcatgtcttcatatgtttatcactgccccctcttgggaatttatatta

SEQ ID NO: 10151 - DNA, 659 bp, artificial
  synthetic oligonucleotide
atcttgcattggagaaaaaaaattgcttatttacctccaattagaggaattaagggaagtaggatttttttgtttttcttttgagacagggtcttgctctgtcaccctggctggggtgcagtggtgtgatcacggctcactgcaacctcaaactcttgggcttaagaggtcctcccaactcaacctcccgagtagctgaactacagttgtgtgccaccatgcccagctaattttttattttctgtagagagaggggtctcacgctatgttgcccaggctagtcttgaactctggcctcaagcgatccgcctgccttgtcctcccaaagcgttggtattagaggcatgagccaccacatctggtggaagtaggcatttggtttcttagataacaacatgattggttgattcagtcacttgggaagataaaagcattaactgagctagatccctatggtagagacacaggctggaccactccatgcgtaagtactaaactaaaaccagtgttctggagtagacattgctagaaatcctgaaacttgagagccagtccacggttaaagcattctgtaaggcagagccagtggaaggtaataaggtgatttttaaagctcttctgcacttcccatattcccttttagggcctttctccctagg

SEQ ID NO: 10152 - DNA, 1057 bp, artificial
  synthetic oligonucleotide
tggagctgggcaaggtggtcacgaagaagttcagcaaccaggagaccaggtgggggccgcgccggcggccgggctagggagagcgctgggcacgcggctgcggggccgggttgggggccggcgcctgcccgggccacctccgcggacgccgcgctcccccttccggggcgggacggtggcaacgcggcctccgcgcccccgcgcccgcgcctgcgaagaaaccgaggcggggcgccgcgcgtcccgatgcgcgcctcggctgtgcccccggttgcagggcctccggtcctgggaccgcggcgacccggcggtcccgagccgctcccggcctcccagcggtgccgcccggcctggcgtccccagcccggaagggagacgtctgggcggtcacagaccgtcggggagagagtgggcgcagcgggcgggaaccgcatcgggtcagcgcgcggtggagagacgtcctgggttggctggtcccagtttccgcgtccctacaaagctgaacctcagaccagtgcgtgcgactaaaggtttccccccgtccccaactctggttgcacgctgggtttacctggggacggtccgaacgctgcttcccccgacctgcccccaagggtttgatccaacgggcggaggatcagcgattttacaagcttccctggcttctcctgagcagccagggcgcagaccactgcgttatccagagggtgcagttgtgccaaggtttgaaagactgtgagaaccccaggacgcacgtgctgggctcccctctgctcccactactcttgctgctttaaagatgatggactttcagcttccttcttgttctaggactctgctgtgtccagcaacaacgccgtgattcgactgtaactttcacccatttctcaagtccaggagagcctcaggtggtggccatcctcggaagctgacctggggggctcctttgtctatctgcctgagtccacacagctccttgactcatttcaaattggtctcatttttcccccttcttcctccaatgtctagtaccgttaactgtccacagttactgata

SEQ ID NO: 10153 - DNA, 178 bp, artificial
  synthetic oligonucleotide
ttgtacccacaaaaaaatcaaatgtccaaattcaatgccaaaagccttcagatacctgtgatgtgggctaattgttaaaaagaaaaatgctgatttctcaccacatttgacacatcactcagaagtgtcagggtgcttgctccaaccttgattttattatcatgaaagtctctatggc

SEQ ID NO: 10154 - DNA, 143 bp, artificial
  synthetic oligonucleotide
tttttattcccaaaagagatgacggccctagctggaagaggtggaaagggaggggagcaagaatggtaaaagtgtatttccagcctgagtaattttggatttatcagtataatctcattaatgcagatggagcattagaactg

SEQ ID NO: 10155 - DNA, 1418 bp, artificial
  synthetic oligonucleotide
ttttgtattttctttgaacttcttttcttcatgcatcttaagaatttcttctggcatctttcttctttttttttaacctggtttatatatatgctttagaatttcatttcaagtgcctctgttggtggtcaactatttctattttaatttgccttaaaaatgtatttattttgctttttattcttaaaaggtatttttgttgattatattattctaggttggcaattattttctcttagctcattaagggtataattccactgtcttgtaacttccgttgttgctgagaagtccgctttaagtctcataattcttttcaagataatatcttttttactctgggtactttaaaaatatatacatttctagatatgtatttcatttctaatttttgtgttttcttttcatttatactctttgttctttggtaatttggacttcttgaagctgtataataatgtattttatcagagtaaaatattatcagatcttacgtcttcaagtattgcctctcttcaatactctttagtaaatgtaggttagatactctcactggagtctctatatcttttaccctctcttctgtatttaccaacatctctgtgctccactctggataatttattctgcttcattttccagttcaataattctttcttcagctctgcttgattttctgttaaaggtgtccattgggttttttaattagtttttatatttttatttatataattcctatttgcttccttttcaactctgctccattacttttttttttttttttttttttttttttttggagatggagtctcgctctgttgcccaggctggagtgcagtggtgcgattttggctcactgcaagctctgcctcccaggttcatgccattctcctgcctcagcctcccgagtagctgggactacaggcgcctgccaccacgcccagctaatttttttgtatttttagtagagacggggtttcaccatgttagccaggatggtctcaatctcctgacctcgtgatccacccacctcagcctcccaaagtgctgggattacaggtgtgagccaccgcgcctggccctccattactttttgtactttcctgttctttgtagatttaaggtgatgtttttgtttgtttccacttgttcagttgttttcacacagaaggctgtcacaaataaacttcttattactggaaactgaatgcccttgtttatgcattccttttttctttctggaagacagcatcctaaggtccttgattttatcagcttaattacagaccacttacaattataaatgacttcttttaagagaccaagtgctttcttatggtgggattcctctgcaaattgacaccattccctgccctcactacagagtagaatattggggtcaagaaaccatcagtaat

SEQ ID NO: 10156 - DNA, 2134 bp, artificial
  synthetic oligonucleotide
ggaaatgaaatgctgtggttaacatataatattttctttgttacaagttactaaattataacctagaatatactctcatggtccaaataatgatactttctgtgcttttctatggtgtggcagattaaataaaaatttgcatactttctaacttaatctttttctgtagaaattaactttattcccaaaagcctatatattcatattgccaattacttgaatattattatatggacttgtagatggcagataatttagagcaagatggaaggcagtgtgaacctctagggacaattcatttctcaaacatgccctgagcaacatatcaatttcatgggaataagcattaattcccgtaggttctgggttcctgaaaaagtccatgtatgccctagatgtaccttccttcaaatcacaagactaatttctccagtttactttctttcttcactatagccctttgacatttgagattggtacttgtctttctaatttttgcaaaacacttaagtttacttattaaacacttctctgttgatatttcattggaagcaagactatacatttacatatgcttctgactttaaggttgttaccatcatctttactcaattcagtgattaaacaacaacaaccaccaccactaccacccttgttacctagcattaactaatgcaatactgcttagcaaacatagaaggaaatacaaaaatatagaagaactgaaatacatggttcttgtctaccacgggcttaccatttagttgttctcaagatgtagacaaaggaaaatacaatgcacagaaccttgtcagatataactagatatccatatgaataaagtactaatggaatttggaagaggtgattactgtgagctgaaacagaggaaggatggttagaggaagttagacttgctggaatcctgaacgatgggtagactgtccgactggagtcaacggataagaatgttccaagtacaggtagggaaggaacatgtgcaaaggcttcttgttaggaaagagcacacccaatttggagaaaagtgaatcaactggccttcatgaagaggaaatatgaaataggagcacattagggggttaacttagatgtagcttcaatttggtggaccctgaatgctgggtggagatgcctgtgcttaatgctgtaaaaaggtagaaatgatataatagcgacatcaggaaatggttaagggaattgtgacacatccacaggatggaatataaagtgtcattaagatgatgtttatgaagattttataatgtaaagtttagctcataagtgaaaataaagatatgtacatatttacatggcataaccacaacagtatgaaaaaatatgctatgaatataaaacagaatgaaaataaatatattaaggccaggtgtggtgacacatgcctttaatcccgatactttgggaggccaaagagggacgattgcttgagcttcggagttcgagaccagtcttggcaacataacaagactctgtccctacaaaaaataaaaaaggaaagaaaataaatatactaaaatatttaaaatcatgttcttaagattcataaattttgaatgactgctttcttttttccattttacttttccagtccttcatgatcagcatacattgcgttttatattaaaaactaaataataattaaaagtatttgtttattgtgaacaaggaactgcatggacagtaaaacaaatataattcaggctatttatatgctagtgggaagaaaaccaggcatcccatgaacagttaaataacaatatagtaattgaattatagctctccaaaatattttgacatcgtttttgagatatattgttgcatgccatgaagtttaccattttaagtgcagagtttgatgagttttagtcaatttgtatggctgtacgattgtcacaagcatctagttttagaataagtttcatcatgtcagaaagttcgtatgtgcttgcttgcagtcaatatccactcccacacccagatccaaccaaccattgatctgctttctgtctttataattttgttttgtctagaaatttcttataaatggaataagataaatgtagtcctttctgtttggcttcttagtgtattgttc

SEQ ID NO: 10157 - DNA, 1175 bp, artificial
  synthetic oligonucleotide
aagagaagagaggaagaagagatgagattacgggaatgaggaaagaatgttggaattttcagttagagaaattaacggatttgcttgtaagtagtgtgtggtatgaatcatctttctcttcttctctcccaaaagatttctccataagatcatcacaaaatatccatttctagttattgcgtcacaaaattgaatctctgctaggatgcatagaaaatactaactataagctgggcagggtggctcacacctgtaatcccagctttttgggaggctgagaagggaggattgcttgaggccaggagtcccaaaatactcaatatagcctcagaatgggattggataagagctgaggtcacctgtagaaggtgtgctatgctcaggtgacctgtatctgactaagtatattaacagtggactaagtagacatttcaatgagttatcagaactaagtaaaaatgttgattgggtagaagaaaatccaagactaggattccagagtgactaggattgtcaccttgggtgaagcaaaaaatcttttatgcctttcattttcaaatatggataatgtgtatattcatctatgctggggtacaataatgtgtgatcacttaaaagaaaacacagacatttgctatcaaaagtcctaccaccaaatagtgagaactactgagaactgagcaagtacttggcactgtgtcatgattgaccactttcagtgattcttcaagtgtaggctgtgaatcctgggagtcctttaaactcattcagggagactgtaaggtaaaaattatatataatttataataataatactaatttttataataataatactaagacttaataatactaagactttataataatactaagactttatttgctatttataataatactaataatttattttataatactactactaataataatttataataatactaagactttatttgctattttcaatctcattatctcattaatgcttggtggagtttttggaggctacgtgatgtgtgatacttcaacaaattgaatgcagaagcagatataagaatccagctttttaaggccagatcttagatttgcaaaaaatgtaaaacagtgccacttttctcacaatttttttttgaaatatattttattaaaaatgttatatgtgtgta

SEQ ID NO: 10158 - DNA, 705 bp, artificial
  synthetic oligonucleotide
tacttcccttactcttctagtctttcctttttataatttgttccccatcagtcttactattgtgacagatagatctggttactctcaaactttagcctcagtgactttcccgggcctagacagaattatctaatctatttatcagaacattccagacgcttcccagcctgttcccatttccaacttcatcctctgccatcaacccccagtctcactattcccagctctatcacactttataccacatcccaaacatgccaagccctttcaaccttctctctctctctctttctctctttttgctgggcttgccagccctcactgatatttttcaagatccgttttaaaacattttcttttaaagattttccagatacttgaactctccccatgctcctgagacttttaatcttgagcaggtgaagaaataatatgagaacaaaggcattgagtagtgtgtggccgagaccacatggtgcttttacctttccccccagatagcctttctaagttggggaacctcatttgaactacgggaactgaaaatgatttgagtgacaattttttcaactctgcctgagatggcacaaaactagtgccattttagatgcacaggagaagagttaagtcattatgtggaatgcatgctatagggtgatggagcgtaattttctcatgggactcaagttagaaagattgctacag

SEQ ID NO: 10159 - DNA, 1062 bp, artificial
  synthetic oligonucleotide
tattcagtgaaggaagaacataagctcttgactagggtccaattctgctaattattttgtgatgaacaggtttcctgatttttttttccaaagagtgatttatgtactaatagcaactgcaacagaatgaaaatatgaggtgataaatttaaggttactggtgtttgcaagtaaggcctgtcttcatatagaccagtgcttctcaactgagtgattttgcccccccagaagacatttggcagtgtctagggattttttgttttcacaattgcacgaaggggtgcaattggcatctagtgggtagaggccatggatgctattaaacatcctacaatgcacaggacagcccctactcactgagaaagaattctccagccccaaaggtccatagtgccaaagttcaaaagccctggcacagatataggagaacgatggattttatcacaaaaggtgacttgaaagtcagagggatgttattttttcccaaaattactcccctaatggcctgtggaatttcattcctttggctctagtacagacctctcattctcttcttttaaaaggcagataatcttgggagaggtaaaatactgagttactacaatatagtcaggaccctatagatgatttgctcttgtgataagaagattgcaggatagagtacttttgaggagtgcgtttgagagtcgaagaagagtatttgacttacggggggagctgctgaaagaggcaatggagtctgttaagtttgtcctcaatttcttatatcatttcctgtggttggttgtttctttggttcacacacacgatggcaaactgtatgttcaggtgtgtatgtgtatgcataagagttgtattttacattagatctaaaatactatttctatcagatgaacttcccatgctttctaggtcttcactttgtgagtgataagggggcttattcatctcagtaacttgaacagcccagagtttacacttagtccatagacttctagaagacatcagttctgtaagaattgatgcttagtctttcattccagctctgcttccatgtttttc

SEQ ID NO: 10160 - DNA, 1079 bp, artificial
  synthetic oligonucleotide
gaaatgtttttctccattatttgtttccctcagtatcctttcaatacattttatctggaattttggcatggccatacaatgtcttagcttacagtgctccttctttgaataatttgtgaaaggactcttttgacagtcagaaatgactttgactcgatttaatactaataaagatatatgttgaagcttgtatgttgtttgcctgttactcagatttgtgttatgctttctcttgcattgaaatacttctatgtttagggccttgccattggttggcttggatatcatggtaatgtcacaactttaggctgtgactttgctgcaggtgctattagaaggagataataggctgccaggcagaggaggggaagactggattcccacaaatgctgtggacttggcaagtcacacacattgcatggatctatgaaaataacatctacgggaataactgaaatgaataaataaagactgctcggaaagttaacaagagtgaagggatgagggagcaagcagagaggatcctgggtgtggactgagggcagtttaagggcattgcattggcagcactaaaggagtggttagacatgtgggagggatgaggtcagaggaagccacctaggggatgcctgagcccacaagactaagccaagaccaaacattgcaagcagaagggaagaagaaaataaccagtgcttttgatttgcatgcacaattgtacagtaggagcttttgatatcctttgggaaaagtgtatatttcttcctgaatgactgaggggttatttagcaaactgaaaagtgatcatgcctcttgactttatatgcaaagctatcctgtcattcttttgttgctttgtgaatattctggtgaattgacgtcctgtttatccatcaagacttctactcatctgctttcccactaagaacaaagatgccttccaaaattgaaaaaaaatttaatggacactttccattgaccttatggctctttgattttgttggcattcttgactattctgtttatagtaaaatatgtttccctctctagtaaaatggatttttttttctagtaaatgt

SEQ ID NO: 10161 - DNA, 695 bp, artificial
  synthetic oligonucleotide
attttttcccctctacgtacaatttactgtcataattgttaggtggttggaagtgtctccattaagaataacaaaagcattcaattcgtgctttttccaggtcctctcctggaagcttgtgcctgacaattaccccccaggtgaccagccgcctccaccctcttacatttatggggcacaacatttgctgcgattgtttggtaagaatcctggttcctgccttctttccatttttcattttgtattctcttgttagctttctgtacaccttgtggtttgggctataattatctaactaagaaatttggggatccaagaaaaattaaaagtaatctatcaaagaaaaggcattgaatgaatcttaaatttcataaaaattatgtttgtaatatttgtactgctactctgtctttgttcagtaagagtttggggatttgtttgataatgtggatgttaatttcagttccagtagagataaggaggggcccagaccttccctgagtgaatcctatgcattgtcagattctgctaattgtaaatggttttgcctttatttttaatgcagtgaaacttccagaaatccttggaaagatgtccttttctgagaagaatctgaaggctttattgaagcactttgatctctttttgaggtatttttattattttgtcaaaacttacacctgttgccatatatg

SEQ ID NO: 10162 - DNA, 2756 bp, artificial
  synthetic oligonucleotide
acactcactcatacagtcaatgacaccctccaaaataatgtttctgaattctctacagaacaagatggcagacatatttcaaaatatatttcatccaatcgttacaaacagcttagcaatagatatttgagttggaaaaaatatcaacattgggtgaagggataaggtgaccctttgaaattgcctgcagcactaacagaaaaccagaacaccatctctttctccagctcccacgactgctccaaagtagagccaacaagtcctacaagacgcacaagcgggtggccactagggacatcccatttccaggcaccatttagcaagtagaagaggaaaacccacaccacggaaaccccttagtgggtgccttgctctgtaaatgtaatggaattaaaggcggtctcctgaaactgcctgggggcctcctccttgggccgtgggacgcgcagcgctggtccctacctcggatttccacacgacgtaggggtgcccgcgactgtcgggtggggactggaacttcctctgctggagccacctcctaggagaagcgaagatgccattggggcctcccccggatgaacagaggatgctggaagcgcttcggctactggctggcccggccaggacagaaggcaggtcccaggccatgctcttcttgaggccgccgcgacccaggggaacctcatagtcaaagtgaaagctgccggatggtgacttctcctgcggggtgctgggtgtggagaaggacgagcaaagaggtccaggaggcggtagcctggtggccctggggggcggaccccgggaagaggacgccaagcgagggccgagactctcggctgggagtgatggggagtagaggcggcccgccgtggctccccgcgcactgccctccgcgcccgcctcgtcgctcccgcagccgccgatcagggccgggtccaggctgcgggtctggcgcagcttcctcttggagaagcccttggccgaggccgcgctacttgaagcgggcgaggaacaggagaagacgctgtggagcaggctctgcgcggacatctcggcggggctgcacctgaggaccacctcctcctccctccctggacgctggtggctttgggtcgggaaccgaaagggactcaggcaaaggtgccaggcggggctggcccggggtttgcccagggcagtggagagcaaagcccagctcacgcgccgccggtgcgctccaagtgccccggcggcggcaggagcagcagatccatcaccagccttctaggaaaatgggtctggggacctcctgcagccgctagaaccttcctccggagcccaagacgcgaagagggtcaggaagaggaggaggaaggtcaggcgctcgctgggttcccagctccagcctgccagcgccactcccccttcctagctgaggcgggagacgcagcgctcctgctcgctggctctggatggcctctaagactccagcaagctcctccttgcggcccgaggacagtcccgagggccagggagaaggctgcctgggcgtgcgcccagggcgcgtccaccgcgctcccggcgccgcgagaacttcctcccgctcctgagccgggcgcctgagctgcgcctccctgcactctctccttgccccggcgcccgaggttgcgcgcctggcctccgctgggctgctgcgcccactcttccgactgcagaggctcaagggttgttccaagctcaaggttcccgcggggtctctgtcttgctgcagtgtggggacaccgagcgtgctgcgcccgggacctccaaagactgcgtgcccacggtgggatggaattcccggcggcgctcagcgctctccgtggaggagggagctcaggagacagccccaaggccgggtgtgtgtgttccgccggagaggaacacgctattcgcagcccagccttgggcccagggcagacgcggagatgaccccgtacgctcgctctagaggcagcgggaagggggcggccaggacgtgtagagctggaggaatgccggggctggagctggggcggagccaggagcaggagaaagcagaacgtgaagagttttccaggcgccaaacctgcaagcggcgaggagagaaggcagctcgccactgataccgggtctcctggggagaaagtcgtgaggacggaagtgcggaccttctcccccgtctccccacccccagatcaagggtcgcgccagctccactcacgtttctggaaaggaagggaagtgtcagattgcaccccacccactggtgtcagatgggcagccggggacgattgctctgaagttggagttaaatctcctgccttttctccccgcgcccccccaccccgccctgtcccggctgtttttgtttttaaaaaggaaggatagataggaaactgtctaaaagcagtggctgccgatgaatgagctggagatggagacctactaagaaagtggagggggaggagcctttgccgtggaaggggtcctgagcacgtgcggaaacgtgctctaggaggaggggtgagtgaggccgggtagggggcaggcgccgggcgcagcttcagcccagaggctgcagagattggcgctcacaaagcgatctgtctccgcgtcccgctctgggacgcctcgggtctcagcgcggtggccacagtcctgggaagctggagaacgctggggaaatcaatcttcccggcaaggagatgagtctgaaagcagcttctcccgctgtcggacccctggaatctataaag

SEQ ID NO: 10163 - DNA, 658 bp, artificial
  synthetic oligonucleotide
agtttgcaaaatacctttgggggcaagagtttaactttcgtttaaaatattttccagttgtagttggatatattcacaattctcatctgccagaaagaaaatatgacccaaacttttgtgttgatgctcagaaagcaagctaggccaacccgtacttccctagcaacaataataattcagtattagtgattttctggaaaaccagagaggcagaatttgtctgtaacatgatgaaagtttcagggagactggttgtgaacacagttccatggagaatttttatgtctattataatctaaaggcagaaccatgaaggtctctgtttgtgggtgatagctaggcatagactgggggtgtcatagatgggatttaagcacgacatggatgtttggaatagacagaagaccttcaaggactttttcttcctaatattctatttgctcgtagaatgctaaaatcagtctagaaatgctaatggagtttacatttagattttgagcaaaaagagaatctgattgtagataggattgtcttaacttagtgctgctgcgtttttaccctggaaagatgttgaatgagatgggccttgaaaagcagtcaacttggtctcatgtaatcactgtagtatgtggaaataaaaacacacctggcttgaaat

SEQ ID NO: 10164 - DNA, 1653 bp, artificial
  synthetic oligonucleotide
atttataatacaatgcattccctaaaactgctttacccagtgaatcattgtagattgtaccgagctcatgcatgattaattaatctgcacaatatgcatggggccacaaagagaaatcactaaagagaaaaagaagataaagttatgaaataaaaattcaattgtcctatataatgaacttgcttcatacacaataccattttcctgtagataaacaaatggatagtcattacccaacccatgctgttgagattctgacataaaattactgtgagtaaacaacaattacatatatcaaggaaaagacattttacatagccacctaagtggaaggaggagcatagtcactgtatgtccctctacctttctataatatttaaattcatgattaacaagaaagaaaggattttttttttaatgcagacaatccccattcacaatcctctgtttgagtgcatagctggagagctaaatctttagaaaatatcagttttcaaggaaagtgggttttagtaaaagtttttttgaaaaaataggagggattaataatacactaatctccttagtaactgaagctaatttatgagaactataaactttcatctatttccaacattaaaagcagagaataagtcaaccagaaaagtatttatggctagctaccaaaattaaaattgattatcttttgggcagaagtaaccagatctttggattggagggaagacaagggatctagtccctgttctgcaaccaagatattgtgcagctttaagcaagtccttaggactctcaaatcttggttttctccagacaatattaaatgttggaccagttgtgtgtctctaaagctctttgcagctcaaaagcaatctatgcttaaccattaatgtgggtttgttttaataatttcatttttgttaatgtataaaagcataacttctaaagacatttaagtcttaggttgtgtccatgatgatgcatgctggatgactcaatgaaaaagggaaccatgatttatcatatggttaattcagggtttaggtatttgatttcttcacttggcatacagtgaaaatgttgacatggattactgccctctaacaaaaatatttttttatcatatttggccagaaatctgtgtgtgacaaagagtagggttcaaacaacagatgagcatatcagcctcagcagctttgcctcctcccttcctcctaacagttgtcctccccgctttcctatctctctccaacatcattaatcaaaaccaaggcttaactataaataggcactggaattgatttaactaactttaacatggagggaaagggctggggtaggttccaaattggctacatttcacttcattcctgaggattttccagcaaggtctaagcctcctgctgccctcctctccctcacagtcttcactgtccctctgtattataactaactacaggcttcctttgctctgactttgtaggacaatctcctaattgtcttaatttcccaaatgcaatgcctgtgctcaattccaatgaggtcatacacaaagtcatagagatatctgtagaaatcattcaaaaatatctaatttttattagtctgatcaatactccaaatatagaatttgactacaaataaagcaggtttatg

SEQ ID NO: 10165 - DNA, 2255 bp, artificial
  synthetic oligonucleotide
atttgcacactcaacatcatttctagaataaataatttatctgaaggtatgttttactgtctttcatatgctgttagatgctacttgtgttgtgaaaattatatatgaattcattttgattgacaaattaatttgctaatttctgtcattatattatatcagacaactaaaattaccatgcttagtaattctaactatgagaggttaaaatggaggagaggtgtccataatttaaaagtttagaaaccattgatataatggttggaaaacactaaaggagaattagtcctaatgatgctttgctaatatgaggagtgtgtgtgtgtgtgtgtgtgtgtgtgtgtgtgtgtgtgtgtgtgtgtcttttagtccatctgcttccaaagtattattaaatgtcacttaagattacactgatatgtttaagtgtctaggctccagagttaaatttgatcttgaatcttacctctctgactcaagtagctgtttgaacctagacaaatgacttaacttcttcaagcctgagtttccatatctgtaaaacaagctttttaatatatccttcttctatgagtgttgtaaagttcaagtgagatatatgtataaagatttcaaatacgaattaaccaattgttgccaggcacagtggctcacacttgtaatcccagcactttgggaggctgagatgggtggatcacaaggtcaggagttggagaccagcctgggcaacatggcgaaaccttgtctctattaaaaatacaaaaattagccgggtgtggtggcacacgcctatagtaccagctacttggaaggctgaggcaggagaattgcttgaacccgggaggtggaggttgcagtgagccaagattgtgccactgcactccagcctgggcgacagagcgagattccatctcaaaaaataaaaagaaaagaaaagaaaaaagaattaaccaattgtctgctgcatcttttttatctgttcccacatctttttatcaatgacactagattagggttgccagacagaatacaggtcactcagttaaatttgactttcagataataaatgaatatttttagcataaatatgtcccaaatattgcatggttctagatgggttggggaaaacatgattttagaaaccctggaattttcaaccttattttgcattatggtcttttcaaagcattgcatgggatctacttataaataccacatggaatatactgtaaaaatatttgtttttctgaaattcaaatgtaactgagtgatttgctaaatctggcaattagttacattagctgaatatgcctaatcacagaggtggtcaaaaggcttaaggacttgtggatacaagtttcagttcagtttttataaattccattaaaattttcgataagtatggctggattccttttaggaaacgtagtctaaagattcacattcttttatgagcaatcgctacagaacaagggccccaaattctgtgtgtgtctgtgtttcttttagtccatctgcttccaaagtcttattaaattcaacttaaactacactgagctattgattgaactatttattctaccaatagacaatacctatggtgcttttctgtggcacgtttagataaaatatttgctaacctttcagcacagagggagatgaagccctgctagtgaagtccagcttaccaagggcatatgttatatattccccttttattctggcatacttctgatttagcccagatgctgtgtagattctaccgattcttgcatttcgctgcctaccttttaccaaaagggttgcctagcagggtccacagggtttccaaatgcaggaaactatagcaaaggttgcttgtccttttaatccacagactgttatcaatgcagattctttgaatgctttgaaaagaccacaatggacaatgaggttgtaaatttcaaggcttctaaaaaacatatttccccagccctcctagaattgaaccagttacaacaagatctttatgcaacagggcccagattctggacactaatagctttgcccctgggtgaagtaggccaggtttccttaagcaaaggccgctattaagcttttgggttctccaccaggtctccaaggcatccatgcatgcataaacaaacaacccgaaactcagcctttcctgtacccatgtgtaagcttaatggcttatattaccaaaacattactaaaaccaacccagaaataaaagaaaatggatgtcaaatcag

SEQ ID NO: 10166 - DNA, 1977 bp, artificial
  synthetic oligonucleotide
tctggctgtgcagcatagcttgcccagggatgcttagcctccctgtaacctgcacacattggaagtgttcataaagccaatgtcacatggatcctcagggaagagttatcacaatagctgccccttacaagaattcattccaatacccttaacagttgcaggaataaaatgcagctgttagacgcaggggcaaacaccaagatgtggcttttctttctctctcctttatttttcataattacccaaagagaaactgttatcaccatggcctataatggaactaaaacgcaggagaaccacttgttaccatagcaacaaagccggagtatattttctgtaccccttgagttcacagtgcagctttctggtgccatctgacttgatttgctaattgctttcacagaacaatcagtccactcaagcattacagttcaagaagtaaaaccttagttacaactgatgataaatattcaaacgtggttcctcaagttgaaagagggtttatatgaaagcgaatctagcaatacaagtaacagttctgaagaacaacattctggagactcacaacccccactcatctatactttcagctttgcttttgctgctcactctgtctacagtaccttctgcaccccgcacaggtgtcactcccctgctccccagagtaagacaatgccctttctccatgatgcatagcaccttggtaacaatctgccccactgtaataccactcctttacatgtttgaaattactgctagactggaaactccttgaaggtagagatgatgtcttccctggcatttaataagggtttaataaatgtctgttgaattgaaatgactctttatgtttgacacttaagatgaaaatcaacagataacaaaagaaactcatgcaaaaattaggaaaacaagaaaaaccacaattacgtatcaacccctgaccccagacttctggcaggagatataatattagtatggatgcaatctgaaatcctaaatattccatcaatgggttcagagtaaccacattgttcattcattcattaaatcattcaaggaatatctattagatgtctattatggactaggtacatgataaatgagaataataatttttttaatttatttttttgagactgagtctcaccctgtcgcccagtatggagtgcagtggcacgatctcggcttactgcaagctccgcctcccaggttcaagtgattctcctgcctcagcctcctgagtagctgagattacaggcatgcaccatcatgcccagctactttttgtatttttagtagagacggggtttcaccatgttggccaggctggtctcaaactcctgacctcaggtgatccgcccacctcagcctcccaaagttctaggattacaggcatgagccaccgcaccaggccatgttttatatttctacaatgttttacagtccatgtaacagtttcatccacagaacctaatcagaggaatatccggaaacacattgagtggttgcatttcctaagatcatacaaaagtgagaaatctggctcttctgaccgatgctatgcttactgttctttttacaaaaacttccattcagaatgatacctctgaagaattgcatgcttctcaacaagcaaataattgaatttttcaaccttcaaaacttcaatattctgctcacataccatgacagctaatgaattttactctacagagattttttcatagaagcaggcatttgcacacaagaatctctctgtgtgactggtcccctgggctttgtccaagggcagaaagctcacttagttattaagataaatagcaaagggaagccaaacagaagctaaatgaattctacaatttttctcagtcttgcagagttgtggaaagtcaagttttccaaatctactcctcactaatatatgctgcaagactgacttagaggcatccttacatgggcatttattaaaagcat

SEQ ID NO: 10167 - DNA, 2016 bp, artificial
  synthetic oligonucleotide
ttttgagcttccaactcggaatatccccactgtctggaggcctgcaaataagcaaacaaaatgaacagtcttgtttcatggcttgagaccctggaggaaatcaaaatacagagcagaatgccagcacagtgccgtaacatgtagagcaatagtaacttgacagcatacagtaatgcttctttcatctcacactatttctattatccagatacttaaaggtcagccctttaagcaccagaattttacgttaaatgtttctgatcaaatatttttcttgtgatattttatatttctaatcttctccttatcagagaaaatgagcttttgtccattatccagaattattacctaaacacacattttatagggattctaactctttattaatttctaaaagatatttcttgttcgtctgatcataattaaagtgtgcttcttaaagaaaatctagaaaatgcggaaaaatgtaaaaataatatacttttagaaatacctgatgcagaaataatcactcttcattttcttttcttttctttctttcttttttttccttttttcttttttttttttttttttgagatagattctcactttgttgtccaggctggagtacagtgacgtgattacggctcactgcagtcttgaccttctgggctgcagtgattctcccaccttagcgtccagggtagctggtactgccagcacatgcctccatgcctgactaatttttgtattttctggagagacagggttttgccatgttcccaggctcaagcgatccacctgcctcaacctccaaaattgctgagattacaggtgtgagccactgtgcctagctaatctttcattttttaaaatccagccttttctacatgaatgtaggtatttttacatagttgagatcacactgcatatatataatatctattgacagagagaatgttactgccttccctcactatcgtgtcgcatgaattttcactcatgctagtaacaattccttataaatgtcacttaaaagggacaaaagactacaaattgggtgtagtgtatactgctcgggtgatgggtgcaccaaaatctcacaaaccaccactaaagaacttactcatgtaaccaaataccacctgttcccccaaaatctatggagatataaaaaagatgcaaaatattctattgtatgaatgggccataatttactccatattcccctctgaatggtgcacaggtccccaaaatatacatgcttatttttctactataaatgaccctattgtgaacaattctgtgcacacgtttttgttcacatttctgattgcttttcctaggatcatgtcctagatgtgaaaatatagtgtcagtgctgaggttgagaaactcatttctaaaaaattaggtctcttaaaaacacaagtaatttcactatcacatattagaaatttcaacaatagttccttaatagcattaaatttccagtcaacatccacataaaggtcacacactgtcatatggtcgatgtgccttttagtctcttaatctgtgtttcctccctctgtctcctttttccttataattgttttggtgaagaaatctcagtgatttcctactgtagatcttcatattgtttggatttggacactccatagtgtcatttgtatgttcttctccctcttttattttctgtaaagagatagctagagccagacattactctgattgcggtgtgattttatagggcaagaatacttcacaaaaagtattgtgtacttcctttgggagcatgaaacgtctgaatggctctcctttttctatgccagtcattgatcattgccattgatgagcatcatgtatattaattctttcattggtggctcattttctcttcatttgagacaatcagttatgagagtgatgggatattggagctgctaaccgccatttgaagccacatgaagagaactgtctgagaataaagccagcaaacagaggacactcatgacatcgtttgaatcctgg

SEQ ID NO: 10168 - DNA, 2669 bp, artificial
  synthetic oligonucleotide
atttgaaagttcgccttaaaaatgcccaaggcacaggaatccttaagagtcataaaatccatcacaagcatggagactttttttctgtcattaatgtcatttaggactgtaacatatttacctatgtcccagataccgaacaggaagcaattgttcagacacacttctaagtagctccagggcaggcaacaatgtctgacattagctctccatatttgtctttcctttgaatcatggagctcacccttcagccccaaagtgctttcagatgggaccttgctgagcgtctgcaccttatttctttcaattacgcttgcattgtctggcctaatgagtttccaaagctagttttcattttatttagggcatgttttcagatgtgttaaattaattggtgctaaataaaaggtaacctgacccctgaagcttctagcaaatacattccattaccaaatgtactattctaaccctcatatgtctaaaaaaacaaacgtaaatgagctgtgctgtacctgtttcttcttgttgtgtatcttgggcaagtcacttaaactctctgagctacagttcccttatttgtacaatggaaccattagttgctttggctgcccattgaaatcacctggaagagatttaaaagatacgggtgcctgagtcccacccccagaaagtctgatttaattgacctgggctgggccttggagcagagtttttaaaagctaccttagggaattttgatgagtagccaaggttgagaaccacaggtctagatcagtggttctcaaattggagtgggcatcagaatcccctagagggcttgttaaaacacaggttacagggccccaccccagagtttctgattcagcagtctggggtggggcctagaaatttgcatttctgacaagttcccaggtagggccgatgctgttggttttggaaatgcttctgtatatcaggggttggcaaactcaggtactccagcccaagcctgcccaccacctgtttttgtatggtccatgagttaagaattttttttttaacattttcaaatagttgaaagaatcaaaagaattatatttcatgacatatgaaaagtatgtgaaattaaaatttcagtgcccatagataaagttttattggaatgcagccatgcccattcagtctaccattagaccaagtgtgggacctcatgtaactgcacaggttgtatgcccaagaagctggctctgactgacattgactaatttaagctccaagcttgatgtgtttacctcctgaaggggatcagaatatgccaaccccaaatatgcctctttggcataataattattttgagctaaagtcaaatgaaaatcaacagctgtcggaagagttctctgccctccctctatctgcctaaaagcagaacatacatttccctttgaagaaggtgccccctgtaccagagagagaagaatgacttttatcatagaagatggggagttgataccaagaagagtttgtataaatagaccttagtccttattgttcattagttcccctatatatttcctagtcattttcccataatttattatcccttgaagcccaaaccctctttcctttgttaaaagggtatgttaaaagcccctgagtctagctgcttctttgtgttttgctccttttgtgtgaactcttgtgtatgtacttttttttctttttttgagacaaggtctctctctgttgcccaggctagagtgcagtgatgtgattatggctcactgcagcctcaatcaacctcccaggcccaagcaatcctcctacctcagcctccagagtagctgagactacaggtgcacaccaccatgcctggctaatttttaaattttttttgtagaggcagggtctccctatgctgctcaggctggtctcaaactcctgggctcaggcaatcctcccgccttggcctcccaaagtgctggaattacaggctagagcttccaaacacagccttgtacatgtaaatattgattaaaattgtgtgccttttctcctgttaatctatcttttgttagtttagtttgcaggcccccagggattgaacagaagaaggtagatgaaaagatttcctccccaatactcgttgcctaagaaatgtgagacattgttatttgcaggctcttcacctcactgttagtcatcccccatttccccctcccctacagcccacatcacatgacataactgcacgaaaggccactccattagacagagagaaagtctcttggaaacaggatgacttaagtcagatgacctcacaatagaaggattgtgggttattacaagaccctgtgccctttctggtaacaaatatccatgaaaggaccatcaaagatgcatatagagcaaaaattgcagaataatacctatgtgtatgctaaaagaaaatgctaagaaaaaaaatgataggcatgctgtgggcaggaagaacaggatggttgatatttatttctaaatatctgaaacccaaagttattccatggtattttaataaaagtcccatatgtaagaatcttttggtaataagaaagatatgaaaacacattttactggaaataagcatataagttgtaaagtttttaaaaagccccttctcctgaaccatgcctctagttaaatttaaatccaag

SEQ ID NO: 10169 - DNA, 75926 bp, human
taaatttataaggcaaactctttatataataaataggttacagggattcagtggggggggggtgtttttgaaacgtatacaggtacattcagacaggtttactgaaatggtacaaatttccttaataaattgccttttgtttttaaatatatcagtgctttcagtcatttggctatacacaaagaaccttttttctgaacactacaaaaaagcaatcaataatttttgtttttaaaacgacctacttattttctaaagtaattgtcccaaaacacaaaaactgaaggtgaatacgatacagggcttttagagacatctccagctaagtgtgtcccggcctctccctgtgccccaagtgcacctctcccaacctcagacaggtttccaggctggagccagctcccttctgcacagggtggcctgtgttactggcaatgctgtccatagctctcggcctctgggctggcacaggggagcatgacttcaactcaggagggggcagacaccctgcctagctcttccagatgctgcacccggcatgcaatggtcactacagtcagcactctccgcctctcagaggagggaggggctgtcaggtgttttgggagcccaaaaccatgcctaatgagggtaatggcttttctaaggagatgttttcgccatggaatgggaaggggttttctcacatctaagttttgctggcgatcgggtgacagccaagagagtgcaagccccctccatggtcattttattgccctgggaaggggagggtggggaatagagatgtcacagtgttgagccctggaggatggggtgggatgtgacggaagtgtcttaaacagtaatgcccacggggcacaccttggagagagaatgcccaccacctggcctgtccaggaagagctgcatctgccaacattagcctgacctgtgcccacagcagagcgtcccagcctcctgcttgggtgggcccagccccattctccccagctcttcagctctgcacacacacatcccctcctggctcccctcaaggaaacatcaatcttgcctttccttaaaagcacgggatggtggtaataatctcggggggaggggaagcaaaacaagaatccactgggcggaacaaaacctggttttgcagtgacttggaaagtggcaacacatcagctattcggcttgctggcttggagtgggactcctgggctccactgctttgggtggcttctggctgatctgggcaggggtcatctgttcagctctcccctctcatctcagtcaccatccccctccctccgaatgcttttgtttgtaaagaaaaagtgtctagaaatatttgtctctggaacaattactttaaacatagttacaatacagacttcagttcaaacacagaagagatttacttagcaaaattcctttcacccaccaaaaattacacaaatataagcctcaacaccacagttaagaggaccagtagagagaacctcatgtttggaacacaaaaggagaaataaaaaccaaaccaaacccaaacagaaaaaccccagaaagacaagtaaagggcaaagaaggaaggggaaggggagcaaacacagcacacgttacagtgtccagatacacgggagcccagcatgggcaagggctcggcacacattgagtaacagtcctggtgatatttggtcatatattcattgactactgactctggagcggctgttattgattgaagcagtgacaaatcaaacggaaaggaggccgtggtagcaagggaaggagcaggcttcaagttctgcaagccttttgcactccactgtccagctccccagaaacactgaaccgggtgggccccgctccatccgggcagggctagaggtcaccgggtgaggctaactcgggcgtcgatttcatgtcagtcagaaaacacgcacgtggacgcacgcagacacccacctgttcacggccaaacatcagcggcaacggcctcctcgcctcctctgcccctatcccaggctgggtgggaaagagcatcatgacccactgctaacactgaacacacgccggagctggccccggatgtgggcccagaggctgccccagccctggtcctccgaagggctcacgggtagcccggccactgaaagggcctatggctgtttttcttttggattcaggcctcagaagaagcaatgacagcagggagggaagcttttggccctggtgattataatgctctctgctttggaagaacaagtttctggatttttttggtgtttctaattattaaaaaaagatgatcaaaaagaactgttacagctaaactctctagcagatattgctcattaagaattacaaaagcaaatgcaattactcgtaggatgggggagaagaaagggacatttctggagtcttcactactcctggaggggaccccttggactgacgcacatgattctggggtccctggcgttctacctggtgcagctcacaggttccgagacaggccaggcctcccgtctccgctccagcccccaggctcgacagagtgggaaggatgaaacacactcggaccctactggcagggaggcctgcgaggctgactccacatgggctcaccctgaccaggtcacgggaaggggactgggggagtcaggccaccccagtggactccagctcccagaggtggaaggcgaccaggctgtgccgactacgttccggacttcagcaggtcaagggagcgctcctgcacccagaaccttgggacctctttcacaagcacgggagaaacaagagtgcaaaacctgggtgctgcctggagcctccttcacctggcacaggaaagcccttgaaagaagcgaggaaaagaccacgaatctgcttggacagaagaagtgaccagcagacagatttgtcgtttttttttcttttttttctttttttattttcccttgtcctatgctatggttatcagaaatattgtaattaagcaacaggtataattttaacaggtctttttttgtgtgtgtggagccacaagcaaaatgagtttataattgtgcaatatacagatatatatataaaaattcaactgctttgtgtgtctagtcggtgcgttaaataaaagggacagaaaaactaaaagcaaaactaaaaagcaaaacaaaagcccaggatagaggagacaaagcaggcctatgcgcacagtctatgtgttactggatataatcagggtcaccaggaagaacagctttgccacttgacacacaaacactgcggggagaggggctatcagtgggcaggagccaaacctcttggccttttcacctcatctgctctcactgctgagcaggacctgattaaaggtaggacagaatgggggtttgggggcaaagagatttccaaattccccaaatgttcttgaattcaaaggtaggatttcctccagggtctgggctctgcctgtgcacaagtcggagcccggagcgggagctgggggttgtgctccctccttgcactgccctcacacctgcttccttctgcctcctgacagggcaggcagggggccttggggaggcagtgagaggccagctcagaaggctcagctgatccgaggcgagcagagcaggagtgggcaaggcaggctgcccctcaggcagaagtgccttcctagttccctgggtgttttcctgacacgtcagcgctggggcaggctctgtcaagatgagaagagtgggaaggagggtggtgctgggccttccaggtcactggtgaacgctccaccttccataccactcccaaaagacaggttcagaagccatgtcctcaggtcggctacctccagattccccttgcctgtaatgctcaccaggcatctcaggccaagtgctaagtatttttagatcagcactgttgtaaaagcttgctcgtattcattcaaaaacatcgaaatgtaattttctgccaaatgttttctaggttttccttctaaattgttgagaactgacttcagtgttcagcttttcccctctaatatgtaattttagaccctgggggaggcagtatcctaacgatttataacaagtagactatgccttttctaaagattgatacaatatctaaaagagaaagacaccaaaatggagagaatcaacaaatcccgtcagagcagagagaagagtaggaagacccggagggagcagggctctgcccccccaccgggcaggtcctccagacccactccatggtaggaactctagaaacagctgactccctgaagtctaggacacaggtcctagaatctgcaggtgtgaacttgaaacaggaatccatttggggcaatgacacaggctaaaaatgtatatgcccaaagatcttcttaaagaactggtacctgtaacctcccctggcccagtcagcccagagagcctgactggaatgctctggaaaaggagctgtggttagacgggggacacagagttctggctgtcaggctccacttgggctaaaccaattccagatggtcccgcgcaggggactccgctcgtatccctctgctccctcctgggcttgagccgcttactaagtgatttaaaattcagagattctgtcagctaaagaaactcctttctccacccaacttggcagtttgtgtctggttattaccctctttcgccatcactgtcacagcaatgaaaagctgggcagagaagcaggtgacaatttggggctgctccctgtcccaggtgcactgttcatgcttcgggcctggaatgatgccacccaacagaagattgtctgcacccgcactggcgctcacgagtagcagcttccgccatccagcgagctgagaagctggggccgttggctagtttggcactgatggattgggggatgtggcgtttctgggtgtcccctgtgtcttttgatatgggaatacagcatcaacagaagggagctgtgctagcgcctggctgtgaccaagtatctccagctcactgagctgtcaagaccggcaatcccactggctatgacaagcccaccagcaggcagggccgggaggggtagacctggggggagctcgacgacatacagtattgtcaggagaggaggtagtaactaacaactggaacaagggtgggggagactgtggatgtggccttaatgacctagccccatgggtactggaaagctgtcggtcaattctgctgttcacaaattcactgaaagaggcccccatcttcataatgttcaagtacagacaaaattgaaattgaggtcacaccccaaaactgggccggacacagctggtgagaatcctgcagcttaaggctttccctccaacctcctgtcaacctgaccccaaggcaggggcagcatgagagctgcagggcccctgcctgccagggcgataaaccgccaaggctgcctgctgaaaggcgactgactcgtgatgcctttgggaaagacgagggaatgaggaagaaagggggaaatagagagaaaaccctaaggagcctcaggccccactggcagctctggaataaactggaagggaaagaggctgggcaactgcctctttgagggagctgcaggtggggcccgaatgaaataaagtgacgcttgaaatgctgtgttcccaaccacgactgccccatcggccctgaatgaactgtcatgggtgacaggggggcctggtgggccacgcactcctcttaccaggaccagatgacgcccaggtgacggggaagcagctctggacaatgattccagaagccacattacatttgactaagtataatacataaaaacccaactgaccaaaataaacatcttctcagtgacaacctggtcggatgctgcgctctcgtggataagtgtcctttggtagtgccaggagttcgaggccactatgggggcaggagccttctgtccttggaggaagagttctggaggactcaccctctcttctgaccccccttcccttcctggggaagagtcagaagtgaagctgggggggtcatcagcagagcaggtggaagggatcagggatcagggattgggctgatgggagtttggttgcaggacttgcttttacagcataaggaaatggacacatatatgctagaaagtccaactatgagactctacaaacagaacggggcaaactccctcacttctaaccattccagaagagacaaacacggttttttcttaagctactgattggaactgtcaactatggttcctgatcactaaagactggcaaggaagtgctagacagtttctatgatgtttcactccttcatgattacaccatagtaaggaagccagggacaataactgaaatacacaagacaacacacacttgacagttcatggcagcagctcacatgggacatgcctgtgggtgtttctggaagcataagactgctgtctcatttgctactttgataaggtacttctcagttggacagatttagatataagagacatctctgtaaacacagaaaaggatataccaatatgatgaagatatgcagctagataaggacttcctgaacagaggttaaaaagatgggatcccacatgaaaactgatcaattaaaaacccacagcaagcccatgcctctaagcccctacaccacagctatggaccagacagacagtgaaatgtgtggtgttctggccccctgtctgcatcgagcaaaagcaaaacattgccattcaagaagaactccgagggaaaagggggagcagaggaagggctggggacccaggtactggtcccagctcgggtcttgggagttctgcattggtaccgctactgccctgctgcactacgctagactctggacttctgagtgaggtcaaggtcggctggcatggagcccctgttgggccactcgatgactggcaggccacaggaggcctctgtgctttcctcaactaccaaatcgggcccagctcctccagtccacttctctagagtagaagggtgaaaaggctcgttgttcagggtgggaaatgccttttgctttttcttaccagggaagagggggctacctaggagagcaagaccttgctgctctcttgctcttcacagacaggccaggtcggactcagcagagcccaaggcctcctcagggctcaaaacagggtggggctggtactggcagcaggaggacaaagggcaggcagagttctggggactggagccgacaagtgtggttgggcaccgcggctgcctggaagagaagggatgaactaggaaggaggaggatggaggaagggaaagaagtgaaaggatgaaatgaacaaaaggcagaaatggaaggggagaagagaaaccaatcaggaagtccttataaaattgcagcaaacacttagagtttcggagcttcgtgggaaccctatgtgctgagcccactttaaaacaagcgcaggtatatatacaaatccaggtagttctcaacactgtcacatctggtggcttgagggactaaatgtcaccaattcaagccagtttgctctcagagcatctgtttgttttgaagtgggaacatgaagactcaatagtgcaaataattctaagctgtccctaaaggagaattggaaagtaactggaagaacattttcttctcctccccctttgccccctcccctgtccactaagtcacagactgctctgagtgattaggaatccctctcaccccgctgtgctctgcccggcctgaccccaggccagcctgcctgcaccttgtcctactgcctccatggcctctagcgccacccgttggaggacgtcccttgagaatggaccatgccacctcaccctgggccatcctctcctgtggttcaggccagtctacacccagtagttcaagggactcccccctcctagccatgccagagctggagcagacaggtgccactttcctgtcctgtgaagcgtccttgccagttttggattggggctggtgtggggccagacttgagccaccacgggtgggatcgcacaggccatagccactggtcatatccatcttctctaaagaatccaactgtctctcctgcctcacacctccctgtcccaacgtggttgggagtgggggaggtggggggagctgggggagctgtagacggggcactgatggcaccgaaaacgggagtgtcctctcaactgctctgtcgctctgtctctaacgaccacatgggggaaaggtttgggcgggaggggaggtgcctggtcaacagcttgtctggtcagtagtatctgcagcaagccttgttgaaggagcctagtttagaaaagtgcaaagctacttctggccctggttaggtcttcaacctgactgtgcttgtcggtaagaaaaacatccccaatgctccaactactcccaccctgaagccacgaaactctaagtttactgaaagaaaaaaaaatattttttatttcagttaatcgggaagctttgtcagagccctacccataaggagaagagacaacagctgcctttattcttgttggtttgctttgcaatccgctccgtgtaaagtcagctaactctctcggtcacgggcgtccggctgtccacaggctcctctctgtttggccttggcatggaggatgaaacaatgtctttgcgctctccctcccctcggtgtttgtacttttctgcggccgtggcggcggtggcaaccgcgggctgagtcttagctggctccttggggcagccgtcgctctccagtgagcctcctctgggcatcttctcctctttgcagacgctgctgctcaagtcctggggctcaggggggctggtggggtcctcggagctctcgggctcaggtggaggtgggggcaggggtgggagcagtggcacgggggcctttggggactctgagtggtggtgatggtggtggtgctccttcttggggggtgaggaggcgctgctgctgcgccccttggggctgctctccttgcttttccgcccagggctcttacaggtcttcagtcctttcccgctcttctcaccgagggtggacaccagcaggggcttcaccacttccttgacctcgatgctgaccgtctcccgggtcttgcgcttcttgatggggagtacggtctcctgcacagatcggatagaagactccttcacggctttctttttggcctcggcggcagcggctgccaccacactccccggctttcggccccgtttcttgggaatggcctgagggtcggcctcagcttttcgcttcctgccggggcgtttgatcaccatgacctgggtggatgtggtggccccacccccctcagccttgccccctggcgaagtttgaaaaggcatcttgacaaggagcttcccaggacttttctccaggacccttttcacctgcacaccctctgacgtggccgccttgggtctcgtggtgccgctccctttggggcgtccccggcctctgccagttcctggagctttgggagatttgggcttcttaggtggtttctgctctcgccgggaggggctccctctcccagttaccgtgaagtcaaaatcattagggtccagggatgtgtcgcctaccttttcgaagtacgcaatcaactccactttagagcgaaaggcttttccctggggactgtggggacaaacagaaagacacaaggaacaattagaggctctccatagcaatgtcagagatagggcagagcggatggtggtgacaacgctctgacaaacgttactattgaacgagagtcacactgcctggctgcccctgaggacctgtcaccaaagccactcactcgtctgcctgccgctgacccccccaggcctctccaaagttcagcaaccaaagagtcaggcctggtacagaagggttgtcaggctgaggcccattctgctggttggtgcctgggcctgagtcaccatctagaacattcccaagtttgaactcaggtacggtgctcagtctctccaggaatcagtttcaacaagataatcctttgctcacccttctcatggaattaaatgaggctgtctgcaaatgtcatttgaaaactgctaacctttttgggatcatttaaaaggcagaactgaaacatgcttcttcacccctctgaacccctagctctgcaagttcctctgcttccgcagctattccatccccagataaagacttgaggtgtggagaggatagagggcctgctaccttgagaacttcccactcagggcagcgacctctgtacacggtcatttcaagcacacctggtctcagtgttcattgtttatgttccccccgaccccaccctgggcacatacattttcctgctccatgagggatccttgtccctgccctccctgccctgtagagataggagttgctcttacttacttgatcaaatacacatcatacttcccagcagagcggccagatttcctttgcttaagcttccgtgtccagccttcaggcagggtggggtcatcatacatgggtccccggtcacggatgatggagcgccgctgtttgggggaggcagaagcttccggcacagccggggcggagcctgacccttctgatgtctctgctttgcctgcctctgcgggctcagcagagtggtgggctgatggctgcacgggctcatgcttgccctctttctcttctttcttatctttcttcacctttttaaacttgaggggtttgtccttgaggccctggaggtcctggtcttctgacttttcttccctgaagtgttaaacaagtatgtaagtatcacagagaacatgccagtctgcagaacaagtgagcagaggcaggcttggacccccaccacatgcaaggccccaggccatcatacactcagatcttgatgtccttccccaggacaacagagactcgggccaagctgggacccaaatatttctttaggaatttgggctgtgggtggtgctggccggtgtgcctgacctgcactgtggccacccacaagtctcctagcactgcaggagaatcagagccctttcctctgagcggaaacactgcggctcctgagcataccaccccagcatgagtcgcacttcaagggactctgggctcgatggctgacaagaggccgtcgactgctggaaagggagccaaatgggggaggggtctcctttgtgaaggccgggccttgggtgtgtttttggttttctagaatgaggctcaatgaggcacacagtacagtgtcatggaaagcacacacaggtttggagccagccaacctgcactgaaatcctttgccgctttccaaacatgaacccagcaaatgacctcagcattctgtgcttcagtttccttatcttgacaacaggtaaccccatctaggcatccttactgtgagcatcacaggagaaaaggcacaatggcactatataaatatcagctaactcaggccacaggaaactaccgcctagggtcctgggggtgataagacaagtggtcccaggtggcgtgagcctctaacacatgttccctgatgaggaatggcctcggccacagcagatgcggagggaagagcaaggaaaaaggtgtggtccaggcagagccatacatccccttcctgccggtggagaagagcaccctacctattctagtgtgggaggcttccccgttcttttctggtgaccgaagcagctccttctctacacatcactttggcccggtggggtctcgtcagaaatggccaccgtgaggccccacaccccagcatcactatctggccatgatgctctagtactctgtcgagtatgccaccgtgaaacctcctaggactccagagcctctgcaacaacaggggcagcttggaaagaagcagcagccacctgcgagtcccttcgttagcagttcattctggaaaagagcatgactactcccaccctccgtgttctcagccccacaactcccctgtcccatgtggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttttttttgagatggagtctcgctctgttgccgatggcataatatcggctcatcgcaacctccgcctgccgggttcaagttattctcctgcctcagcctccggagtagctgggatcacaggcgtgtgctaccacgccaggctaatttttgtatgtttagtggagacggggtttcaccatgttgggcaggctggtctcgaactcctgacctcaggtgatcgacccgcctcagcctcccaaagtgctgggattacaggcgtgagccaccgtgcccagccagagcttccttttcatgtctctgagtcttacagctctcaatgggaaatgacgaagaaccctggaaagctaggtgtggcctgttgcccaccagagatcagcctttgagaatggacccctaggcagctccccagctccccataaaggagggagggaaggggagccaccagcagagtgggccaagaaagcagacagatgggaatcgctacttctacacaatccatcatggcactgcctaacgccagggctgctccctagaacccggacggtcctaatgtcagagaaaaacagtgaactaatgggaaagatctggcttcttcgaaactctcatttgcatttcccaaataccttaatcaccatgaggtcaaactataaacctaaacgtgacgtaaggaatgccttctagaaatctatgctaaagagacacctccagaaatctcaaagaacatatgcatgatgttatttgctacaacattatttttaccagccaaaggcttccaatacccccgatccctatcaccagggcacttgctgaataaacttatggtgcgcccacacactggagtactgtgcagatccaaagggactaaacaagagctctaagaactgcgatggagtcatttccaggatccactgtgaagcaaagggagcaaagcgcaaacatatctactgcattctaccaaagaaagaagggggggtattaaggaaggacacaccaggaactaatgaaattgattccctgcatggggtagggggaaaaaggtaagggtacaggcacaggagtgaggcctagctgaacatgcctcagtgtaattctgacttctgaatcatgtaaatgtttatattacccaaaataaaattcaaactaaaagtaacaaaaccttattacacttaatgcaaataaaaacaaatgagttcgggccaggcatggtggcttcagcctacgatcccagcactttgggaggccgaggcgggtcgatcacctgaggtcaggagtatgaggctgcagtgagccatgactacatcactgcactccagcctgagtgacagagcaagaccctgtctctctctctctctttttttttttttgagacagagtcttgctagagtgccatggcgtgatcttggctcactgcaacctccgactcctgagttcaagccttctcctgcctcagcttcccgagtagctgggattacaggtacctgccatcacgcccggctaatttttgtatttttagcagagacggggtttcaccatgctggccaggttggtcttgaattcctgacctcaggcgatccacccaccttggcttcccaaagtgccgggattacaggcatgagacaccacgcctggccaagaccctgtctcttaaaaaaaaaaaaaaagaaaagaaaaaagaaaagaaacaaatttaattctatatcaaattgacaatataccacagagaaaagatttatttcaaatgacttttgactacagtgctctgcaaacctgtagtgggacatattctaaggccaacaataacactccaggggcagtaaacacactagattggctcccaggagagatatgtgattctgcttctggggcatcttgtgccagaaagcccggggagtgcaagagaaaaacagggagggcccatgagaggcctctagcagtggtccaggtgtggcccagggtgggggcagttgaggatttggggctggtctaggtggtgaagcaacagagctcgcaggtggattagtgtgggggtgaggggcaagggtgagtcagggaccatgtccaaagcctgggaagatggtggtgccactgattgagaaggaaaagactgaggggccggctgggtgcagtggctctcacctgtaatcccagcactgtgggaggctgaggcaggtggatcacctgaggtctggagttcgagcccaacctggccaacatggtgaaactccgtctctactaaaaatacaaaaatgagccgggcgtggtggcaggtgcctgtaagtcccagctacatggaaggctgagggagaagaatcgcctgaacccaggaggcagaggtcgcagtgagctgagatcgcaagactccgtctcaaaaaaacaaaaacaaaaacaaaaccactggagcggcaggggagcaacacccacagagacagttataccatcaaggagagaaaacagttcttcagctactcgctagaaaggggggaaaccccgctgtgatcagattctgagttgggcctgaatgaaaatgaactgtctgcttggggttttaaaggctttttattgtggtaaaatatacaaaacaggtcaggtgtggtggcttacacttgtaatcccagcactttgggaggtgaggcaggtggatcgcttgagctcaggagtttgagaccagcctgggcaacatagcaaaaccctgtctctacaaaaaaaaaaaaaaaaaaaaaaaattagctgggcatggtggtgtgtgcctgtaatcctagctactcgggaggctgaggcaggaggatcacttgagcctaggaagttgaggctgcagtgagccgttgatcatgccactgcactcctgcctgggcgaacaaaccagacacatatatgtctcaaaaaaaaatacatatatatatatatatatatatatatatatatatatatatatacacacacacacaaaacaaagtttacctttttaactatttctaagtgtacaatgaatgaacttttttttttttttttttgagacggagtcttgctctgtcacccatgctggggtgtggtggcgcaatctcggcttactgcatacaggctctgcctccctcctgagttcaagcgattctcctgcctcagcctcccgagtagctgagattacagatgcgcaccaccacgcccagctaatttttgtatttttagtagagatggggtttcgccatgttggccaggctggtcttgaactcctgacctcaggtgatccacccacctgggcctctcaaagtgctgggattataggtgtgagccaccatgcctggccctaaatgaacttttaagagcactgaagatgggaaataaagggtctttaactctactgtaatattctagttctttctaatggaaattacttgaagcaaatatagtatgatgattttcaattctgtgcaatgaaaggcacatgggtgtttgttaatttgctggctgctacttttataattaaagacaaatttcaaaaaacccacaaagaagcctggattgtgctgggtgtggagtgcaggtaaaaatgataaaaaacgtggatggagctggagtccattgtcttcagtgacacagctcagacacagaaagtcaaataccgtacgttctcacttagaagcaggagctgaatagcatgtgcacatggacagagtgaggaatggcagacactggagagactgggaagggtgggagggggtgagggatgagacattacttaacgggtacaatgtccactattcaggtgatggttacactgaaagctcagacttcactactatacaatatatccacgcaacaaaactgcacttgtaccctttaaatttaacaaataaaaaacaatgatagaaaacaggtattccaaatgagtttacccttagcccagagggcctgcccagtcccagggtgacctgggcatttgcacaccctcactaagccttcactgcaggacccaagggagggaggctgggctagggtgccaggtgactccccaaggctgtcccccagggggtttatggtgtttgccgaaacacaaactttttcaaagaaacctgccaggtgtggtggctcatgcctataatcccagcactttgggaggccgaggcaggtggatcacctgaggtcaggagttcgagaccagcctggccaacatggcgaaaaccccatctctattaaaaatacaaaaattagctgggcatggtggtgcatgcctgtaatcccagttactcaggaggctgaggcaggagaatcacttgaacccaggaggcagaggttgcagtgaaccgaaatcgtgccactgcactccagcctgggtgacagagtgagactccatctcaaaaacaaacaaacaaacagaaaacaaaacaaaaaaaaccccatacacctctcttcatcctccctctaatcagaaccccccacacacacacaatcttgattatgaggagaactaaatagctagttcacaagttcatacattttacagttgaagtatcctcagaaaaaccacctattcaactcctgagtgttacagatggaaaaaaagaagttcgactagacagaggaacttgtctgagatcaccgtgagtcaaaaacacacgtgtctgttcaccaactgccttcgtcctgagccagatcctgcagcatccttccacctccaagaactcacagtttggaagggaggacaaataggtaactacaacatagttccagcctcccttccccctgaagaaagcttgctccaggcacagcggaagcacaggggtgtggataatgaatcaggagtgagtgggctgtcagggcttatgagttccacaggtgggacagagggctcagggcatgccaggccagatgggcagaggcggcactatcaacatggttatagctcccaccctatcacccgtgtgacgcccctccctcgaggaaaaagtgaccaatgatgcccaccctgtgtcaccagaggctctgggcctaaccctgtcaccccctcccaccttttcatttggagaactttcaggttcatctggagaactttcatctttcaggttcagttaggatggcacttctagaccgggcgcagtggctcatgcctgtaatcccaacaccttaggaggccgaggtgagcagatcacttgaggccaggagtttaagaccagcctggccaacatggcaaaactccgcctctactaaaaatacaaaatatttgccgggtgtggtggtgtgcgcctgtggtcccagctactcggggactgaggcatgagaatcgcttgaacctgggaggcggaggctgcagtgagttgagatagtgccattgcactccagaccaggcgatagaacaagattccacttcccaaaaaaaaaaaaaaaaagatggcacttctgagacaccttccctgctcctgcctccctccctgctctatgagccagggcacccgagccctcagtgtacttagaacaccccactgtgcgtgccaacccccatctccccgctcaatgcataatgccaggcacaggtgcaacccttactcaacacatgctggatgaataaccacaacacggacgcagcgctccacgtgcttcttctgatggctggagaccttcgaccgtaagcttctagcaaggagaggctagctcagtgctgaaaaaaaggtgggctctgaattggtgaataaacaaatgatgagtttgggacatatcagtagtccgttggacactggtggcttggagatggcggaagatgaggtggaggaagtcactgaggagggcctcagtgccccagggacagtagcatggaggatggttacgccagaggatggatcgacttctagccatgtggtggtcaggtatgcagacacctctcctgctgaaacaactacaactgccaaactgagtatcttacagaagctgctagagaagccacccacaagctggcaagaaaggaaggaatacacaggctgaagagcaaataaaagtacggggcccttttctgtggagaaatctggcaggcaccaccttaacacacgaccaaactgagctcaggcccctcagtgctgctgagatgaaccagcatcacgagtaggagactgaagcttaccgtgaggagacagcaggaagagtccagagagggcgtgccatgcaaccacggtctggactcaagatgatgagagaaaacaagggggtgggggaacatttctgataaaggagactgaagggatgacacaatcgaatacaacacacagtcctggactctgcattccaggctcaaaggctctaaaaaaggcatttatggggtatgtggagaaatgtaaggttctgtgttagctcattgctaaacttcctgagtgtcttaactgtactgtctgctcttaggaaaggcatgcttaaacgtttaggagtgaaacagcacgaggactatgactaactctcaagtgatcaatgggctaggggaaatacagtgccaatatggtaacatgtttaaaagaagggagatgacatcaatataatcagaagctatgccaactgacagtaatattttgaagcagtggtaggcaagctttttaacaattaaagagaatgccttcatattacacaaagacattaagaaaaaaagctgaaggctgggcacggaggctcacacctgtaatcccagcactttgggaggctgaggtgggcggatcacgaggtcagttcgaggccatcctgaccaacatggtgaaaccccctctctactaaaaataaaaaattagccaggtgtggtggcgcgcacaaagggaccggggcggtgctggcggcgatgccaacagacctcagtgtactgtggggttctttcagccagaactgttcatggtttcatcagtgagctccagttaccacaccacacaagtttggagtgatccaccccgccccagtttttcctgcacgaactcatgtttttattgtgtgatttacagaacacaagatctttttctaagaatgcacacatcacacgttgaagcagaaaggcctttacaaaatcttaaaatacctacaaaatatgaagtaaggctcttaagaaataaaatattcaatgattttgctgctagaatgcaaacattagatcaaatccttcatttgatctagcaaaggaaaattagagttgcaggaatcttgttttcaggccaaaccatgacatcctgaggggtctgatggcaggaactgcctgcattttcctcatgaatgtgacctgcagtgatcttgtgagaaaggcccggaaggccgtgcaaattacaggggtacaagcaacagctggcaggtgtggccagacaggcaactgcagttaaggaaagactactcaatccctgaggttttcagattttacaaaaaggcaaaaaagccaggtgaacaaggcagatgaaaggtatttttcacttgaattggaatccagccccctccctgtcccctggagtgagctccagagaaacttccagagccccagcaatatcccaacctttcgtaaattcactcatgctcgccactttcaggagatggcatttctcagcacctttcacttccagttatccctcggcacagcacaaagagctaaactaccactcgaggcagttaacctaagggcagggtggtggctacagctccaggtgaacagtctgggaccagaggaaataatgagcccccccttgtactggctgcttccaccctaaagtgtcatccagatggtgtttccaattctttctacttccagtattagctgcagaattacggaatcaaggaggcttctctgcatgaatcaataaaggctatagcactttgagacacaagctttggccctttaaaaatgtgagaaatcaaactggcacaggcagagtgtctcagtggtctccagggagcaagagagaatgaggttcagcttgaaggctacaagggtggagcctgaggttcagctgccctgctctgaattcgcagtccatttcttaatcctccacttttgagaagatgcgagaaaccagttatgttttgctaagcttaaataaaatgcagttcttgccaaccaaaagcagaaccctccccaaatacaggcaaccagtgccatacagcaaatctcatctttatagatgtgtaaaatgaaaaccgaaacacaagcccaccacatacaggttaaaaaattcctgctgtggagaacagtttggcagtttctcaaatgttaaacatggagttaccatatgacctggcaattttactcctagccatacactctcaaaaagccacaactatgccgggtgcggtggctcacgtctgtaatcccagcactttgggaggctgaggtgggtggatcacctgaggtcaggagtttgagaccagcctggccaatatggcgaaaccttgtctctactaaaaatacaaaaaaatttagccgggcatggtggtgagtgctacctgtagtcccagctactcaggagactgaggcaggagaattgcttgaacctgggaggtggaggttgcagtgagcagagatcgtgccactgtaatccagcctgggcgacagagcaagaccttgtctcaaaaaaccaaaacaaacaaacaaaaaaccaaaaccagtaaccaaacagatatccgtacaccagtgttcatggcagcacagtttacaacagccaaatggtgggggcaacccaaatatgcattcccaagggatgggtggataatcaaaacctcattatctataggatataatatcattcagcctcaaaaaggaaagaaattctgacacatgctacaatgcagatgaaccttgaggacattacgctcagtgaaagaggccagacacaaaaggccaaatagtgcataattccatttataggaaatgtccagaataggcaaatccatagagacaggaagtggatgagttgttgccaggggctgcgggtaataagaggtgactgctcctgtgtctggggtttcttttgggtgctgaaagtgttctggaatgacacagaggcgatggttgcacaactctgtgaatgtactaaaagacactgaattgcacattttatttttaaacaattttttctgtgagcctatgaattatactgaagaatgaattgtacactttaaatgagtaaatttcatggtatgtgaattatatctaaattaaaaaaaacaacaacattaaaacagcagctgaccaccaattattctaaatcataaagataggttttgtgatgcctggccagtgctcagagcccacacagctgtctcagagcaagtctatctggctgtggcacagagccccggcagatagatgggctgtccgtctgaggaagaggccaatgtggggacctatagtgatacatgacagactggaccaagccaacctgaatgtgaaactctgaagcccaggacacaataaccatgacaatcagaaaggaatttagttcaagaagtttaatgagtaggcatttagccaagtggaaggttgttggctattctgaggacatttgatcttttttttttaattgtggtaaaatacacataacataaaatttatcattaatagcatttagtacattcacaatgtcatgcgaccatcactactctctagttccaaagacaaccctttacccattaagcagttgctccccactcccactcctctcagcccctggtaaccactaatctatttgtctccacaaatctgcctactgttgacacttcatataagtggaataataccctcccctggaaagcctgtcttttaaaaaatgattttcatttaaaaaagtttttttgcttaacacagtggctcatacctgtaatcttaggaaggcagaggcaggaggattgcttgggcccaggagttcgagatctgcctgggcaacatagtgagatcccgttattcacaaaaagggggaaaaaagaccaggaaaaaaaaaaatcccaaaactaaacaacgaaaaagttttttttagggagatagggtctcgctgtgctgcccaggctgggctcaagcgatcctcctgcctcaggctctcaagtagctgggactacagatgagctaccacgcccaacttagaaacatgtatttttttcagattagctcatcattccctggtaacttctccaatgatttccccttgcatctctgccactatattctagcagggttctcacactgatcctacacacaagtggttagagactcaccaggccaagctcacctccaattccaaatacctagtcctcaaggtccaagtggcctgtttccatagacactgacactgtgcatgacttttctgtcctcagctgctggctttctccatttcttgttgataatgtttttttcttacctttacatacttcatgtaaataagtttcacagacttttaacaaagtgttggctgcttttatcaaagaagagaaaatctgccaaaataaattttcaccatgaaggcaacacattttggggaacaagaaagggcagaaaggagatctcttttactagagaactctgcttaaggactggctcatttgatccaaacatctcatcagtaacttggagtgagtgcccttgttttcgtcatcttgcgtctcactagtgtaggtcagtccacatcagcctgcctgacgtacttggttcgtaatgctgacatctgagcccccatgtttatttcaccctgattctactgaaatgaccaacgaaatgcaaaacaggaggaaatatctctatcaatgccttcagaggaaccgctgtagaatgtggtgtggctgggatccatgcgagagaagcagctctcacacgattccaccacagttaaacacatgggcaaaggagggacctgccggaggtatgaggattccgtagcagagcccaagaaaatctgcaagatcagagaaactgggcctaagagccagactggcagaagtacggtttgccggtggcaaatagaaggacctgaaccaccagtgccctaggtggagaggtcagtgacaggctggccaggttttcctgggcactgctgggacagagagagacaccaatatagaggagattctacctgtctcaagaatctgccagcagcaccctgggtccccaccctgactccagctgctgccacaggggaagcagcagggactgaagctccaccccataaacaactctagggactggggatcaaacaagtaccaacaaattagtaactgtcctgtgtacaaatacaaattaggtggaaactataatgattgaacaccagtcattccagtcaagatcccaactggaggccgggcgcgatggctcaagcctgtaatcccagcactctgggaggctgaggcgggcagaacacgaggtcaggagttcgagaccagcctggccaacacagtgaaaccctgtctctactaaaaatacaaaaaaattttagcctggtgtggtggtgcgcgcctgtagtcccagctacttgggaggctgaggcaggagaatcgcttgaacccaggaggcggaggttacagtgagccgagattgtgccactgcactccagcctgggcaacacagcaagactctcgtctcaaaaaaagaaaaaagatctcaactggattttctttggaatctgacatttacctagaataggcatctgaggacagccagaaggagtgtgtgtgtgtgtgtgtgtgtgtgtgtgtgtgtgtgtgtgtgtgtgcagggggggggatggcttccttctggtagccactgctctagggagtatttctcaccatcatgtcacaaagcacacaacaggagcactctcacatggattagggaattagatgcagacctcctgcacaactgccctcttccagtcctagtaagataagacacaaaagaaaggcagggaaggagagtgtgaagggaagatttcagcacacaaaggaaaggggtgtaattcaaagcagtctgagaaaagactccagaggacaaagcagcagcaaagccaggctcctgccccgtcccccagaaaccaccctagggagcgggcaacgccctgggaatttgcagtcagtaagctggagagaagcaaccaagtgggagtccttcactttttccttttagacccagaaactccagctgggaggtgcaggagaaatggcaaagtgcccagtgagccagcccagctctgtgggaagcaactgctcttaggtatacacagattatggaaccacccagagactgaggtgccccctatccccatggaaatggcacacacatccctcgtgcagctagagtgagccttagtaagacatccaacacagttcttagaacaaagagaagaatccagatagggctgaagactacatggctgcagctccctccagcgtgcaaattctctccggatacaagataacaagcctgcacgcgatagctcagaggggaaaacagcaagagaagatgccaagaaactgggaagagagagccaagaattcctccactgtctcaaagcaaacagaacgactatgcagagccatccaagcctgagccaagacgaaaagaagtgacatggtaactaggcaaacatattatggccagaagaaaaaaaagaggcccagggagggagatggcacgagaaaggcaaagtctcccaccaagaagagaatacacaaggaagggaaaaaaattccccacaacttcataagaacatgttcccaataaaagagttcaaagatgggatgataaaacagaataagatgaaaagacaaatttccaacctagagaaacaaactgcagaccaaaacacatcattatgaaactaataaatacattgaaaaacagccagaaacagaatatacatagctgaaaatcaaattagacaaagtgaatgcagatgaaaaagacaaaagctaaaccaattacggcaaagctaatagcattggaagagagacaaagacaatccaacatgaggaatttgtgtccctgaagtacagaactcaacaaatggaacagaagatgctgtcaaagatccataagagagctgacctgaaacagcaacgactacatctgcagactgaaagaatacaccatgttcccaggacaatttgataaagaatgctcaatagcaagccagactctagtcaacctactcaacttcaaggataaagaaagcattcttcaggcaccttgggattcttccaagggggaaacatcagaagaccagacagaatgtctacaaagttctgaggcagcttagcgcagtggtggtgggggagaggtcagaggtaaattcagagagatggacaggggccaaaagcctctctgagaagacgaaatctgaacacagatctgaaggaagtgagtggtgagggagcaggtcaagtaaagaggggtccagccaatgaggagcagcaagagccaaggctctgactctagcaacattatggcaagttccaggaagagcaagagcagtgggagccaggtgagcaagggagagaatggtagagaatgagctcaaataggcaaggagggatcatgttccatgtggctgctgaggcaggcccagttacacaatttgtggagcctggtgcaaaatgaaaatgcagggcctcttgttcaaaaattaagaattttgagatggtgagagtagagtattaaaccaagcctgggttccagcaagcccatgggcagttacaaaggcccatgaagctggctctgctttcaagtaatggacttcgggttttattctgagagggtttttctcaagggagtaacctgatctaataaacatttttcaaagagcccatctgaggctgggcacactggtacacgcctgtaatcctgcattttgggaggccaaggcgggaggattgcttgagcctgggagttcgagaccagcccgggcaacatagggagaccccagtctctacaaaaaatataaaaattagccaggtgtggtggtgcatacctgtagtctcagctacttgggaggctgaggtgggaggactgcttgagcccaggaggttgaggctgcagtgagtcgtgactgtgccattgcattccagcctgggtgacaaagggagaccttatctcaaaaaaaaaaaaaaaaagcccattctaactatgggaagatatagagtagagggagtggggcaggagggcacaagatgccacaggggggctctgcagaagcagatgttgggtcacggtttgaggtgtaagatgttcatcaggaactgacatccataaagggaggtgggaagaagtcaaagagaaggccctataagggccttgtacccttacctcgctcagtcaccagggtgctgtcctggaaatggcgtgaccttgggtgaggaggctcttgcagctgaggctaaccggagtgtccgcagggcatccagagaggagagtgacctccgggtctgccacgtgagactactgcagagtctaggcagggatgcagggagctggtctaggtgccatccctgaagggcatgggcaccgggacagcgaaagggcgagagatccaggactctggcttccgtttctcatgtttttgatactgaggtatttagctttctagaggcctaaagggcagctggatgtatgaatctggagttcaggggagaggtctgaagagccaggcgagtgcgtgagggcgtgctgaatataagtgtaaacaaccctccccctgctatttggagttgtgatgaggagaaagaatcagcagaggagacagagaaagaggagtcagtgcagagaaggaagatcagacatatctgtcaagattattggtggcaatcaatagaaaccaactctagctgatttatgcagacaaggactgatgaaaagctattgaagatgcatgtggtgatggttgcacaatataaatgtgctcaataccacagaattgtacacttaaaaatggttaaggcagtacattttatcttttgtgtattttactgcaatttttaaaactagggggaaaaggctactgggtgataagagaatccctagagggttggaggaacaggtttgagtccagttggctaggaacaatacttcaaatccttctgccaagccagtccaaacagccagcactgcctgtgcgaccctgcaaggcagcagcactggccactggcactgtggcctaggagctcgtctttcctgcagccccaatgccaggagacacggctctcctgcctggccctgctcctcctagcatgtgagtctgactggcagaggccagggtacatacctacaccctcgtgtagaactcaggtaatttctttctgtaaggggccagatagtattttccaccttgtgggccagacagtatctgtcacaaccagcccacctgctgttgtacaggagagcagtcttggacaatgcacaaaggacggggtggaactgggtcctggtaaagcttcatttacgaaaacaggcagtgggccggacttggcccttgagataccgtttgccaactgctgccctgaccgaaagggaagctaggcaaataagcatctggcatttgcagtgactacaatcagaggtcgccaggcctcccatcaactcgtgaggtgagaattctcccaaacccagagggttcaagatgtgaggtgagatggccacctggagagtatgaggtaccagaagagacacaaggaaagggctgagaaggagtgacagccactgatgactgttaagattatttcatggaatgtggaaaagcaagtgttcatggagcaagctgagcaaggagcagcaggcaaggaagagggcccatgagtggagagaactcttagagagtttggctaaaaggagaaacagagactgagcaggagccaaggaggtatgcgctgaagggagctcagttacgatggtaaattctaaaacaagttcgtctggtgatgggcacagttcacaagaggagggaagaccaatggagtcccaggggcatcaaacagtggttgacactgcaagctgggaagacagtaagtcctcatcataggcagagctaagttagaactccgtgggtggagttccagagatgaccaactccaggatacgaccatgggaatgagtggcagaagagacagggaaggagccaggcactaggagggcggcctacatgcgtgtgtgtgctggagtcaggaactggcacggaatcctcaataagaggactgactggggcagtgagcaagcccacaatcaggggtctgtgggccgagaggctgtgtcacagtccccctatgccatgcctggaggcacatgggatcagagacctctgaggacttggcaggaggcacaggcgtggagaggcagggcctaacccaggtgtgtgtgtcgcgggggggaggggggcggtggttaggcagggctctttggggaagagatacctgacagggtcttcaaggataagcacgacaaggcaaggccacaggggaaggaaaggagaagagaaggggacttgggcaggggagccaatgacaaaggccaggagtgcaagaaacatggtacctgggaggaactacaagcagtcctggactgctgagggctatgtccataagaaaagcagcagcaacagaaggggccacaaagagaagcaggagccacatgaggggccctgatgtcactcaaacacagggtgccactcttgggtttaaagcaggggaatgagattgatgatagggattgtgtggaagatagagaggtggaggaaagatcataagttatcatgggagtcccagagcaagatgagggattgaaccaggacagcggtagaagggatgacagaagacaaaagagggacaaacagttaaaggaacaatttgtgggacttggtggctcccttggatgtgggcagtgaagggcaggggcctgttgggtttccagcttgggtgactggtatggctatcaactgtgacagaaaacagtggacatggcatttgtctatttggtcttctgatctaccttatcttgaaggagacaggggtggtagggcgcccagtgggttgagaagaatggaagggagaaagagggcagaaatctctcaaatgttttgcacagtaaaatctgactaaaatgcacacacgccccacaagcctttttctttttttttccccccaagaagcaaaacaagttttatttccatagtagttccttttagtgctctctgtcgccacctaatggatggcctggtggaagaggctcaagaggtagcagcctagcctattccacggcagaggaatcaaactcacccaggcagggagaacgggactgcacctgggtgggggaggaccaaaagaagcccagctgcttctggaagatcattgggagtctcttctggaagaccaggggctcttggagctaaaatagacgttcgttcattaataatacctacttcaacaacttaagatcatgttcagcggatgcacatcaaccttgacttgtctgtgctccccaaatcaatatgcctcaatattgaggcatattgagggaacaatctgtagatattcatgaaattgtctggtgggacaaaaattgtggggcacttgagcctagctgaactcagttttaagttctagcatttaacacaccacctctaagtttacgtgtactttatgagtgcaggaatgcaacaaaaaaatctagtgtaaagtcctggccctcagggcaaagcaagggaactacaactcttgctgcgaactgccttcctcccacagatgtggcacattcacaaatcacattcattgaacaagaaatggaacaagtgccacaccagaggtgacaagaagaggggaccatacaataataggtaacttccctgtcacacgagactgcttggagacaaggatacagagcccagcataggagatgggacaaaatgatgagggtcaaggaccacacctggtttaactcccagtgaagagttttagccagtaaagagctgcaagaaggaaatcacacaccacgaagaggccactaagataaacgcttgaatctgattaagttttcacctgaaaagtgtgggtaaggacaagcctgccttgttgggtagtacagattcagtgaatgagccctcagatcctgctggatcccgtgatcagataaacagcagcttctcaggaaccactgcatgtgaggttagggtgaggggagggacccgatggagatctaatcccaggggtttggtcacaggggctggcgaatgagaggtggagaccgggaacatacgccactttttttttttttttttttttttttgagacggggtctcactgtgtcacccaggctggagtgcagtggcaccatcttggctcactgcaacctccgccccccaggttcaagcgattctcctgcctcagccacccaagtagctgggattacaggcgcctgccactgcgcctggctagtttttctatttttagtagagacggggtttcaccatctcggccaggctggttttgaactcctgacctcgtgatccacccacctcggcctcccacagtgcggggattacaggcgtgagccactgcgcccggccagccactctttttttttgagatggagtttcgctcttgttggccgggctggaatgcaatggcacgatctcggctcactgcaccctccatctcccaggttcaagtgattctcctggctcagcctcccaagtagctgggattacaggcatgcgccaccacgcccagctaattttgtatttttagtagggacgggatttctccatgttggtcaggctggtcttgaactcctgacctcaggtgatccacctgccttggcctcccaaagtgctgggattacaggcatgagccaccaggcccagcctaagccactcttttggaaagctcagcagagaagatgcatgaggtaatacgacgcgttaggtggcctttaaagggatgtttatagcttttcataacatgggtgtattagtctgctcaagctataacaaaatagtacagactggggggcctattcaactgaaatttctcacagttctggaggctagaagtccaagatcaaggtgtcagcacattcagcccctggtgagggctctctttctgacttggagatggctgccttctcattgcatactcacatggtggagaaagcaagctctctgctgtctcttgttataaggacactaatctcatcatgcgaaacccaccctccctcctgatttcatctaaacctaaccacctctcaaataccccatctccaaataacatcacattggaggtttgagcttcaacactggaattttgggggacacaaacattcagtccataacagtgctgatgtttatgttttaatgttaaatgataacagcacagcacagcagcacacacactgtgtgatgccaatctgtttgtttgtttgtttgtttgtttttttagataggttctcactctgttgcctgggctatagcagtagtgtgatcacacctcactgcaacctcgacctccaggttcaagcaatcctcccacctcagcctctcaaagtgctgggattccaggcatgagccaccatgcctggcctccaatttgtatttaatgccactgaactgtacatttaaaaatggtaaattttaggtgatgtgtattttactacaatttttttaaaagtctaagagaaggcaagaaaggagaaggaaaatttaaaagaacagaaaatatggaaaaatagaatgcacaaatatgctataaatgaatctaaatacatcagaaatcaaatagatgttaaaggacgaaacagacaatggattttttaaaaaatctcgaggccgggtgcggtggctcacgcctgtaatcccagcactttgggaggctgaggcgggcggatcacgaggtcaggagatcgagaccatcctggctgacacggtgaaaccccgtctctactaaaaatacaaaaaaaaaaaaaaaaaaaaaatcagccacgcgtggtggcgggcacctgtagtcccagctactctggaggctgaagcaggagaatggcatgaacccggggggcggagcttgcagtgagccgagatcgcgccaccgcactccagcctgggcgacagagcaagactccgtctcaaaaaaaaaaaaaaaaaaaaaatctagctatcagctgggcatggtggctcacgtctgtaattccaacactttgggaggctgaggcgggtgatcagctgaggtgaggagtttgagaccagcctggccaacatggtgaaaccacatctctactaaaaatacaaaattagccgggtgtggtggcacgtgcctgtagtcccagctactcaggaggctgcggcaggagaattgttttgaacctgggaggtggaggttgcagtgagccgagatcacgccattgcactccagcctgggcaacaagagcaaaactccgtctcaaaaaaaaaaaatctagctatctgacattttcaaaagctccacctcactgatgcataaagacacagaaaggaggaaaataaaaaactgggatggccgggcgtggtggctcacacctgtaatcccaacacttttagaggccaaggctggtgaactgcttgagcccaggagtttgagaccagtctgggcaacatggcaaaaccctgtctctactaaaaatacaaaaacttagccaggcgcgctggtgcaagcctgtaatcccagctactcaggaggctgaggtgggaggaccacttgagcccaggaggcggaggttgcagtgagctgagattgcaccactgcactccagactgggtgacagagggagaccctgtctcaaaaaaaaaaaaaagaaagaaaaataaataaaataaataataatttaaaaaaaaataacatattagtatggtcgcttcataataccaaagggttcaatacaccaggaatgtgaaactgtatctaaaactgaaaatgtggcctcaaaataaataataaaatgaaaatgaccaaactctgtggagaaactgatgtgtccatcaccacagtaggttttaacacgtattccatcagttgataaatcaagtaaacaaaatgacagtaagaagagaaaatactttcacaacaaacggataagacagaggtaatgaatatatgtagaatcctgcacccatgcttggtggtgacatattctgtccactggttgtggataatgtgtcatggagcacttctcaaccaactgcaagaactggtgtcacacagaccaagttctttgatcacagtgccatttagttagaagttgattttttctttttttcttttttttttttgagacggagtattgctcttgttgcccaggctggagtacactggcacaatcttggctcactgtgaccactgcctcccggttcaagtgattctcctgcctcagcctcccgagtagctggaactacaggtgtgtgccaccatgcccggctaattttgtatttttagtagagacgaggttttggcatgttggccaggctggtctcgaactcctgacctcaggtgatctgcccgcctcggcctcccaaagtgctgggattacaggcatgagccacctcatgcagtcaatttttttttctagagcaactaggaaaaaaaaaaaacaaacccaaagccatgtgcttggaaattgaaaaacacattttaaaataatatgtgagtcaaaggaagaaacaaagaaaatttaaaatatctttgggctaacttaaagtgacaatactatcagaacttgctagatacagttgaagtagttccagagggttagccttaaatgtttacatttgaaaaaagggtagaaaaatcaatgaaccaaatttataacttaagaagttagggccaggcgtggtggctcatgcctgtaatcccagcactttgggaggccaaggcgggtggagcacctggcgtcagcagttcgagacccgcctggtcaacatgccaaaaccccatctctactaaaaatacaaaaaatttgccgggtgtggggcaaatgcctgtaaatctcagctactcgggaggttgaggcacgagaatcacttgaacccaggaggtggaggttgcagtgagctgagattgcactactgcactccagcctgggcgacagagcaagactctctctctcaaaacaaaaaacaaacaacaacaacaacaacaacaaaacacagagaatgtactctaagaccatagaaaaaataataaagataaaagcaaaagcagaatttaatgaactagaaaagagacacagagtaatacagggcaataatgcctacatgtctgcttcttgtaagaccaatgaacctaatgagcttttaccaagacaaggaaaaacgggagaaggtacaagtaaacaacaaacactaggaatgaaaaagcagacataattacagatgttgcaaatgtataaactataacatgaacaactttatgctagtcagacaaaatggacaaattcctagaaaaaaaaatttaacagcttacagtagcccaagcaggtgcagggaaaataaaaataggtttagatgtgtctgcgtgtacatagaacacctcaaaagacacagacaagaccctggatgcagccgttccctgaagagaggcctaggcagctgggagaccagggcagcagggacactcagaccttgcatcactctggagtttgcacttcctgaattgtgaagcatgcacatgtctcacttatgcaacagtgaatccaaacgtgcctgtatacaaggaaaggcctcacctggctgcgccgtggaggctggcctggcgtgtggagcaggcagaacattagcaagctaccgagcaggtgcaggtatgaacatcagctgacgctggctctttgctttctttttaatcttgacaaatttggtaggtgaaaaggcatcatttttgttctcgtttgcatctctttgattaccagcaggcagaactcttttcctatcttcattggccatctgtatctcttcttttatgaatttcctgttcatagtctttgttcattagtggtgactagtggtaagttagcaataagaactgtttgcattcaagtctagactgagaaggaaattaaaaaatctgcccatgtattctcacaataaatgactactgactagcctgagataattgtacccactgcccagtcacaggcattaagcctaggatgattcatttcagacttgtccctgaccttcctcataccctttccagaagggccccttgagctgctatgatactcctaaatcactatcccattacccaaatgatggagagccaatcaaaagcttagaccaggacgctttcccaaattatgtcccaataccttcacaatgatcactttatatacaatctcactgaatgctcagcaacacacgagagcaatgtttaactgagggcaacactgaggctcaaggagggcaagtgacttgattgctgaggtcacctgctaggtgcaagagctgagaattaatcccaaggctacctggctcaaaaagcctaagctcatctactatacttgaggcgaaatcatgaaagtgtgtttttaccttgcccagaccctgcacactgcatcaaggtcctgagtttcaagcaacagaaatcaactctggttaaattcaatcacaaaggagttcttgggcagcagatctggaaatggagagagaactagagaactaggctcagaaaagcagcaggaatagaggctgcaccactgcaaacacagccaaggttatactgcagggacctgctggttgggacacccaccctgggcactgttgcatgtcatcactggacattagccaccactgctggttttgtgactcaactgccaccaccatgactaatccctcactgtccctcaagagtcaaagtccctgaaggcagaatgggtttggccaaacctaggcttcatcgccatcccctagtttccagagagcaaggggagggaatatatccattcccctgtggcaggcactgccagttgtcccccaacatccatgttctccatctgccttactaatgagaccctgcgctcagctaaggagagttattccccgcttcccagcagaccatgggactacgttatggctaaggagacagtggccgagtgcactcctgttcatcgttctctttcaagcttgctcttgttctactgactatgggcggagcacacctcccacccactgactctgggcttgctcacgtgttgatgggatgggggaagaagaggctttaagaggcttctgtgactctgctcactcctcttggactcctgacctccgcctacgaagagacttcccctggcagctgcttctccctcctgggtcctggaacgacaggcttgagaacagatctgaatcccatcttgcagctgacccagacccatgtgtgagaaataataattgctgttatagctactgagctgctggtgctgtttgttccctaggacaagatgatgggtgtgaagatggaaatggaaatattgaatgggcctagaagttaagatgtcaagtgccattttgcctttcccctatgacctctttcttcctacctggaggagtggatgcaatgactagagcagcaaccgtcatctcacaaccaagaggcaatcttgagaaatggaagacacccactgaggggccctgggtcctggatccttacaaagccactgcagtggtcatggacagcatgagaaggaagtacaccacaggcccccaaccccatcttcaggttttcttaggtagaaactagggtccacctgcctcttactaagatatacacaatggggagacttttaacacaaaaaaaggtatgaagatggtcagaagccaaaaaagcaacaaaatgttcatgatatgccgtatgtggggtttactcactacactgcttttccaccgagttagcataatcactataactcaacccattgaaaaaatgacaaaacagattctgagattctcttcctatttctgttagctaaaaaagcagcctttgaattgtttataagtgaattcaagagataaaaataaacccagataattcagaatgtactgagtacaacacatatgccttctatgtgataagctcccagcattatttattcaaagaaaacttgccttgttgcaaaaatataaaaaaacttaaaaaaaaaaaacaagtaattacacaacacaccacctcctacaacaccagattccttttctttcctttgtaacctgaccagaagaaaaacaaaacattgttcaaattgctgagacccacaaagttcaattagagcataaaaaatgctctcccaaaatatagctactagcagggaaatgagcaggctaagcctcctggtgaacctggacattgggcacaagtaacaggcacatttagacaccaacgaccagattccacatgactgaatccagaaaccctgccccttcccattcccttggagatccagggggacgccatcaattgctcactccttctccttacacatacagttaggggtgctatactatacaggggaaggcgtgaggaagtcacacatgctttggtgttcaagaagctcataaagccattagggaaagagcaacatgccagaaagcagttgtctcttctggctacagaggttgcaaaagacgtctgcaagggtcagtgagggcccaaaggagtagtaaccaaggccctgaagcctgcctgggagctgaggtgggcagtatcagcctcttctcaataatcagttcctaaggttccatccgagaaagtagaaaaccacagaggccattctcatgggtactttaagcagtacatctgttggcaaaacacaaatgttgttacacaaatactaagccacagattgcaaaggcacctgacagcctttaaaattcatttctcttgtttcgcaaagctgcactgggaaactgtgctgttaaattctacactcataaaggaggtatgttttaaaagaggggcaaatatgtgggtgctatttagactctcattgatttgttccatgttttcagataactacacacccctccgcccccgccaaagtaactcaatctccacatatttgcctttatatgtaccttctaactcatgactatggctttgattatctcataaacaatattgttcctgttagccatggagaagctaaggagccaacagcagagcaggctgcatgttcttctgtccctcttataagacaaaaccttagagcaatgtcccactgcagaatttatttgttaattcactcaataaattaaaatatgcatgattctaggcactggggatatattgaggaagaggcaaaaaaaaaaatctctgtcctcatgggactcagattctataggggtggggagagggagggaggggaagggagtgggagagcacaaacaaaaccaagcagtaacacagcttgtggcagatggtgacaagtcctatgctaggcagggggaactggtggggcagaggcaggctgcctgacttacagacatgggtgtgctcggggaaggccacattgggaaggtgacacttgagcagacatgtgtgatacctgggacagagggcagaggagaggtcaaggccttgaggcaggggcatacttggagggtccagggaggagccaggaggccagtgaggccgcagtgcatgagtggtgggagagtggcaagagaggtgatcctgttgggctgtgactctgagcaagcagggacccactggagggttctgaacagaagagcacaatattgcaggactaaacaaagaaccagggggcaagggcagaggcagggaagctggacacctggaccagggtgggggccatggaggcaggggaactcatgagattttgtatccatcttgcaggtggagtaacagtatttgtgaacaaatgaggtaaccagcgccaggtttctggcctgaggagcaggagttggagttgctgtttactggaaaggagaagaccagggaaagagaaggtctagggaggataaggagttcccgtgacccagtcagcctggagacataaatttgggagccatgaggctggacggaatcacttcgggagtgagggtggagaagaaaagcctgaacctgaggccttccaacatcacatgcgaaacagaaaagaccgaggaggacagacattcacacactcacctaggacttcctgaggacccacagacaccaggcactgttctaggagcttgagctacatctgtgaatcaaggagacaatcctgtcctgtggagcttctgctccagcaggggtgacagctaagataagcacagtcagtcatgtattcagctagaaagagacaaaagctgtggtttgcactgagaaggtgcacatcagtgcagagactcaagggagggaaaggattgtctcgtatgggtattggggttaactgacgacgacagctctgggaaaagaagtgacaagcagctcccagatttaacaacatgaaggtcatcactggagacctcatggagcagcttggcagagctgtggcagcaaaggaacaactggagaaggttgaagagggtgtggagacagggactggagtcttgctggtaaaggaaaacagagatgctagacaggtggggggttgggagcagcttttgtcaaggtgggagaagtagcaacaagtttctagggcaggcgagggaggaatctctgatgggggagagtgcagtagaggactggagagatgccttagaacaggagtgagggcctgggacaggcgctccgtgacagcatgagggaggcagagcgaaggagtagacgctggcctgtagacactctcttgagcttgcttctgtgctctctgggaactaagatatcagctgcaaggaggtgtgacagctgatgaggagggtgggaggggctaggagagaccggggaactgcagtatgcaggtgggcttggcggcaagaagtttacctggggtagacatgaacttaaagggggaatcaatgaaggagtcacattcagcttcaggacggagcaggcatggggcagacatgactgaatttcatgaggctggggctttgtcgactgaatataacaaagcaagaaagtgccgaagggctgaggtagtgtgccagggagtaacgacgtctgactggcactgaagctacaaaggagaggaataaggatacgaaggaggtgaagtctgagaaaagatggagccactgatggattctaagtgcctgtgaggtcaaaggagtattggagttgggtattagaggcagtgaaaaggaaaaggatctccttttgcagatcacaaaaaagataaaatgaccagagctaaacaacttttacagcactatccactgtaaaagttgtttgagaaaaaataaaatgtagccagccttcagagcatatatgcatctttattttattttatttattgagaccaagtctcactctgtcgcccaggctggagtgcagtggcacagtctcaattcactgcaacctccgcctctggggttcaagcgattctcctgcctcagcctcctgagtagctgtgattacaggcacccgccaccacacccggctaatttttatacttttagtagagacggtgtttcaccatgttggccaggctggtcttgaacccctgacctcaggtgatctgcccgccttggcctcccaaagtgctgggattacaggtgtgagccaccacacccagcccagagcatatgcatctttaaaaagttgtcttcggccaggcacggtggctcacacctgtaatcccggcactttgggaggcagaggcaggcggatcacctgaggtcaggagtttgagaccagtctgactagcatggtgaaaccccgtctctactaaaataaaaaaaattagccaggcgtggtggtgcatgcctgtaatcctggctacttgggaggctgaggcaggagaatcgcttgaacccgggaatgcggaggttgcagtgagccgagatcacaccattgcactccagcctgggcaacaagagtgaaactccgtctcaaacaaaacaaacaaacaaaaagttgtcttcaagagcataatcaaagatactttcacttcttaatgttttgtttccatgtctcgtcacagaacatggtacagacaaatattagaatagactcaagggatcacttgattttaactacagaaactttccggtgaatcatgagcactgtcttgtttccagctgctgaagtatatgggcaccagacaagagcacagcgctgtcactcaaagccaggagtaatatggctgttaccatgaggactacttagcagaagataagcatctcattatgtctacagtgaactaaactattgttgccaatggtatatggattaggaccgactgccactgcccatctgcttatagcttagaatctggtgaatgcaaacaactgttttggggggacttctggcccttccttgggctctgctatcctggaaatggacaggcttctacaggggttcgatggtagccccgaatagttaggtgtatgtcttaacccccagaccctgtggctctgaccttatttggaaggtctttgcttctgtaattaagtgaaggatcttgatatgagatcatcctggatttagggtgggcctaatacagtgacaagcatccagagaagaatacggggacacagagaaggccatgtgaagacacaagcagagaatggagcaatgcaactgcaagccaaggaaagtctaggactgccaggcagccaccaaaagctggaagaggcaaggaaggatccatgctagaggctctggggggaatggagccctgcaacatcttgatttcagacccctggcttcctgcactgtgcaagaatacagttaggggtactttattctgactactccataaacttaagctctaattctcgctcagcttctgagctttaacaaagggtccgtgcaacttctaccgttcccgttccccgtctttaccaaagaggaagcatttactcaaagcccacctcctgcaacagctctagatgccgcttcccccctccacacaaggagtctgctcctccaggtccccatttcctccttctcacgctcccctctctcctgggccattcccagaaggatgtaaacatgctctcatattcacccacgtgaaaaacaccctcatccccctctaccccactcctatttttctggtcaccatcacaacaaaacttcttaaagagagttgtctatacccaatctccactccctcaccttccactcactccaatctggcttctgtccccatcacctctaattcagttcaccatgtgacaggtagggtttttgctagttttagacataatggatcttgttattcctgggctttaaagccttcaccagaggatggccaactgcctacatgtaattgccacttgacccttcaaacctcaaagaaaccgaagtacagacatatgaaagggaagaaatttctaacagaggcaatagcaggagaggacctctgaacggataagatacactcagcaaatttctagatgctggaagtaggcaagaacatgttgactaatggaacagagaggaatgtactacaagagagctgtagagcagatgagagcctgtatacctgtcagagccccaaagaagctctcagaccagaccagaccagaccagaccagaccagacgagaggaggggcaagcagtgctgtcatgtgtgcaacacctgggggctgctgactgccagatcccgacccacaagctttggggcagggcaccttcaataagctcccaggtgaggctgatgctgttggggctggtgagcagagcaaacttggagtggcaaggtgccacttcttccctcaggcaagaaatcaatgggtcttttctaaatcaacagctagaaccttcccttccccggcccccaccccacccaccccaaaggctcttgatgtggctggcagcagcccaggtgatgcctaccttttcccagtctctgagggtccatggggcaagagctgacccctgcctcgcctccacagaacttctccaaaccacccttcagagacagaccccgcaggcaacgggccactccaccacagcagagaaggggcagcgcagcagctacccaggtcctccccccatccctggcggctcaagaaccagccccatggaagagagaccaagtctgtccttagaggaaacaaataatattctcagagaaatcttagaatacagaatagtcataaaatcagaacagaaacacccataaacaagaaataaacagatgataaaagaaaagtatcaggcagggcatggtggctcatctctggtgacaccacaccaggcgtggtggcccagcactttggggggcagaggtgggaggatcacttgagcccaggagttcaagaccagcctagacaacacagacacacaccagcccatgtctacaaaaaatttaaaaattagccaggcatagtggcacgtgcttgtagtcctagctacgcaggaggctgaggcaggaagaccacttgagcccaggagttcgagtctgcagtgagctatgtatgatggcaccactgcactccagcctaggtgacacagtgagactctgtctcaaaaaaaaaaaaaaaagtatccattaaaatattttcaccctttaaaaatcaggttgtctttttattaccgagttataggaattcttctgaatacaaatcctttgtcagatatgactttctattttttctatgactggtctcaactgttttcttggtggacttgtcttttcattttctttgagacagggtctcactcagtcacccaggctggggtgcggtggcgcgacctcagctcactgcagccttgacctccttgggatcaagcaatcctcctgcctctgcttcccgagtagctgggactatggactacgggtgcacgccaccatggttggctaattttttgtatcttttgtagagatgggatttcactgttgcccaggctggtcttgaactcctgagctcaagcaatccatctgccttgtactcccaaagtgctgggattacaagcatgagccacagctctcagcctattttcttttgttttttctttttctttttttttttaagagacactgtctcactatattgcctatgttggcctagaactcctgggctcaagtgatcctcctgcctcagcctctcaagtacccagtagtgactacaggcaagcctcaccacgcccagctctgtcttttcattttcttaatggtatcttttgaggaccaaaagttttaaattttaatgaagtccaatttattttttcttttaatagctattgcttcatgtatcctaataaatctttttttggcctggcacggtggctcatacctgtaatcccagcactttgggaggccgaggcaggcagatcacttgaggtcaggagtttgagaccagcctggccaacatggcaaaaccctgcctctactaaaaatacaaaaattagccaggcatggtggcgcacacctgtaatcccagctacttggaaggctgaggcatgggaatcgcttgaactcgggaggcagaggttgcagtgagctgagatcgcaccactgcactccagcctgggcaacagagtgaaattgtgtttaaaaaaaaccttattctttggactgcacagatattctcctatgttttcttgcagaagctttatatttttagcttttaaaacatttaggtctataatctctcatgaattaatttttatgtatggtgtgaagtagtgtcatgggttggactatgtcccccaaaaaagatatgttgaagtcctaaccctcagtacctcacactgagaccttagttggaaacagcgttgttgcaggtgtaattagttaaggtgaggtcacactggagtagggcaggccccaatccaatattactgttgttcttacaagaaggaggccatgtaaagacagagacatacatggagaatgctgtgtgatgaggaagacagatattgaagtaatgcagctgcaaatcaaagaatgccaaaggttgccaaccactggaagctaggaagaggcaaggaaggactcccctacaggtttcacagagaccatggccctgatgacagttgattttggacttctagactctggaattatgagacagcaaatttctgtggttttgttttgagacggagtctcactctgtcacccaggctggagtgcagtggtgcaatcttggctcagtgcaacctcccaggttcatgcaattctcctgcctcagcctcctggctagctgggattatatgtgtgcaccactacacctgactaagttttttgtatttttagtagagacaaagtttcaccacgttggccaggctagtcttgcactcctgacctcaggtgatctgcccgactcggcctcccaaaggccgggattacaggcgtcagccaccgcacccagccaaatttctgtggttttaagccacctagtttgtggcaactctaagaaactaatatttagggtaaggtcaaggttcatttttgtctggtatggatgtcatttgccatcatccggcacgtgctaaaagactttcctttcccgcaccggactgttctggtgcctctgttaaaaatcaaatgactataaagtcacatcacataagccccttaattttgttctctttcaagtttactttggatgttctaggtcctttgcatttccatatacgttttatttatttatttatttgaggcaaagtctcactctgttgcccaggcgggcgtgcagtggcatgatcttggctcactgcaacctccacctccgggttcaagtgattctcatgcctcagcctcccaagtagctgggattacaggtgtgtgccaccatgtctggctaatttttgtattttttgtagagacggggtttcgtcatgttagccaggctggtctcaaattcctgacctcaagtcatctgtctgcctcagcctcccaaagtgctggtttacaggcataagccaccgtgcccagcttccatatacattttacaatcaatttctacaaaaaaaaccctgcagttatgactggggttatgaatctacagttcaatgaagggagaactgacactgtaaagacacttagtctttcagctgatgaacatggtacaacattccatttatttaggtctttaatttctttcagcaacattttcagtttcagcgtgtaaatcttgtacatttcttattaaattattcctaacgatattgcatttgaaatttcatttctgattagtttttgaatgatctcgtaccctgagaccttgctgaattcactttttagttctagcaggttctgatagtttctttcacattttcgacattacctacaaatagaaacagttttacttcctttaaatattaatgcctcttatgttttttcttgcctcattatactggctatgacctctagtataatgttgaatagaagtggttagagtggacatctttgcctttttcctgattttcggggtaacatgttcaatatttcacaattaagtacaatctatctgtagctctttcatacatgcacttcctctatttctaatctgctgaatttttatcatgaaagggcactgaattttgtcagatgcgttttctgtatttattgaatagactatatggtttttctcctttattatcttttttttttttttttttttttttggatactgggtctcactgttgcccaggctagaatgcattggcgtgatctcagcttactgcaacctccgcctcttggtttcaaggattcacctgcctcagcctcccgaatagctgggactaaaggtgcgtgccaccctgcccggctaatttttctatttttagtagagacaggatttcactatgttggccaggctgctctcaaactcctggcctcaagtgatctgtccacctcggcttctgaaagtgctgggattacaggtgtgagccaccgcacccggcctcctttattatcttaatgtggtgaattacaccaactgatttttgaatgttgaagcacactcgtgtttctgcgaaaagcctcttggttgtaatatgcaggcgcacctcatttgattgtgctttgctttactgtacttcgcagatactgagtttttaacaaattgaaggtgtgtggcaaccctgcatcaagcaagtttaccagtgccatttttccaatagcatgtgcttacttcatgtctctgtcacattttggtaattttcacaatgtttcaaatttctcattattatatttgttatggtgatctgtgatcaatgctctctgatgttactactatcatcattttgcggcaccacaaactgcacccataaaagatggcaaacttggccgggcggggtggctcacgcctgtaatcccagcactttgggaggctgagccgggcagatcacctgaggtcaggagttggagaccagcctggccaacatggtgaaaccccgtctctactaaaaatacaaaaaacaagctgggcgtgctggcacatgcctgtagtcccagctactcgggaggctgaggcaggagaatcgcttgaatccaggaggcagagactgcagtgagccgagattgcatcactgcactccagcctgggtgatggagtgagactccatctcaaaaaataaaaaaaataaaaaaggtggcaaacttggccaggcggcagtggcttacgcctgtaatccccgcactttgggaggccaaggcgggtggatcacttgaggtcaggaattcgagaccagcctggccaacatggcaaaccctgtctctactaaaaaatataaaaattagctgggtatggtggcgcacgcttgtaataccagctactcgggaggttgaggcaggagaattgcttgagcccaggaggcagaggttgcagtgaactgagatcatgccactgcatgccagcctgggtgacagagcaagactgtctcaaaaaaaaaaaagaaaaagaaaaagaaaagatggcaaaacttaagtgataaatgtgtatattctgactactccaccaatcagctgttcccccatctctctctctctccttgggcctccctattcccttggacaagacagtactgaaattaggccaattaataaccctacaatggcctctaagcattcaagtaaaaggaagagtcatatgtctttctctttaaaccaaaaaccaaatgatcaggcttagtgagaggcatgttgaaagccgagaagccaaaagctaggcctcttgtaccaaagttagccaagttgtgaatcaaagttcttgaaggaaactaaaagtgctactccagtgaacacacaaatgatatgaaagtgaaatagccttattactaataaacgttaaggaagttttaatggtctggataaaagatcaaatcaaacacaacatttccttaaggcaaagcctaatctagtgcaaggccctaactctcttcaattctatgaaggctgagagaggtgaggaagctgcaaagtgtattgtttaatttttaaatatttggggctttctctggatcttccattatttcttttttttccccccactcactctgttgtccgggtaggagtacagtggcacaaccacagctcactgcagcttcaaactcttaggttcaagcagtccctccacctcagcttcctgagtagctgggactacaggcgagcgccgccatgcccagctatttatcgtaatattggtattataattttgtaattttatgtctattacaagataaagcaaataagtaactatgttaacattagtaagacccaacattttcagtgtaaggaaaagatatatacagatcaaataaaagttggccaggcatggtggctcacacctgtaatcccagcactttgggaaatcgagatgggaggatcacttgaggccaggagttcgagaccagcctgggcaacgcaacgagaccccccatctctacaaaaaatttttaaaaattagctgggcatggtgatatgcacctgtagtcttagctactcgggaggctgagggaggaggattgtttgaagcctaggcatttgaagctgcagtgaattaggattgtaccactgcaccactccagcctgggcaatagagcaagaccctgcctcaaaaaaaagaaaaaaaaaaaaaaaagttaaggaagaaccctgtaatgttaaattgccatagaagacatcattatgtatttatgacttaaaaaaaaaatggagggcacagtggctcacatctgtaatcccagcactttggtttttttatttttcttttgtgaaaatatttaccagcagtttgccctgacagatgtaatcccagcactttgggaggctgaggtgggaggatcgcttgagctcagttcgaaaccagcttgggcaacatagtgagaccttgtctctacaaaaaaattaaaaataaaaaataaaaactgaatatattttctagcgatgtcctctgaaagtgcctagatataatgttaccccagtaagaatcagcacatttagtacccacatgttggattctaaataccgttgccactataaggaaccagagctccttggaatcagttctaggacacgaaaagcacatattgggatggaatatcttgtgccagaaaacaagaaattgctcaaagactaattaatgagggtatgccaggagaatataggaaccaacatgaagggactcttgttgacccaatttgaattgtaaaacatttaataaataaatccctatgagtccatattgacatgaaagagaaaaggaaacacaacagcaaatattttgccaccatttgaggtgattattctaccaactccttactctgaaatgtaataaaggcaaagattaagcatctatactgtctttttaggaggaaatataatgcctccttatttgatgagggaaaattcattacagaggaatgacagtactaaatgtagaagaggtgacaattaaaaaaactatcattttgcaacccccaatgtaataatggtttcaggcaaggatcaatgaatgctaaaataattatgcaaatggctgttgggcaataggatatttgtatggtgccaaagcatcacatcacagattatatatcaattaccacaggaaaactgtatgtctacaatggggagatttggcagtcacctccttctttaatcaagtgttaaaacgtagcatcacaaaccacagggtaaccaaccattaagtgcctggtgagctgatgctatatgaagtacacagtactgcctatgaaatattcttgcccaaaatgtttaacctgaacatgcctgtagacctaacttcttgtctacaagtaatatatatggacaaacaagttaaattatatcacaagaaaagagagacatctaaaatgtgggccagctagtcgtggtggcacaagcctgtagtcccagctacctgggaggctgaggcaggaggattacttgaggccaggagttcaaggccagcctaggcaacatagtgacacgccatctctaaaaatatgtatcttaaaatgtgggcccttctagatgacaattgggctgactgcttcaaaaagtcagtatcacaagtgaaggagaggtgggtaggctgttcttgttaaaagagacaaaggggctgggcatggtggctcacgcctataatcctagaactttgggaggccgaggcgggcagatcacttgaggtcaggagttcaaaaccagcctggccaacatggtttagtagaaaccctgtctctactaaaaatacaaaaaagttagctgggcgtggtggtgcgtacctgtaatcccagctatttgggaggctgaggcaggagaatcgcttgaacctggaaggcggaggttgcagtgagctgagatcacaccactgcactccagcctgggagacagcgagactctgtctcaaaataaaataaataaataaataagagacaaaggaagcatattcaaatgcaatgtataaatcttaattgctttggagcccctcaacagcgataagagacatttggaggaaatctgaatttaaagtgggtgcctgataacattagagaattattgttaacttttaaagatgtgatcggggtattgtgcttatattggaaaatgtccttatttttaggagatgtatactgaagtacttaggggtgaaatgtcgtgacatctgtgagttccttttaaatggtgagcaaaaaggtataaaaatgcaccctatctatacagaccaggaaaatacgccaaaatgttaacaattgtctaatctaggcagtaggcacacaggcttcacagtaagttaaaaaaaaaaaaaaaaaggtttggctgaaataaagaatttaacagaagggatagaaaataaagtcaggaggctgggtgcggtggctcacaccactttgggaggctgaggcgggcggatcacttgaggtcaggagttcgagaccagcctggcaacatggtgaaaccccatctctattaaaaatacaaaaattagccgggcgtggtggtgcaggtctgtaatcccagctacgtgggaggcagaggcagaattgcttgaacctggaaggcagaggttgcagtgagccgagatcaggctactgcactccagcctgggtgacagagcaagactctgcctcaaaaaaaaagaaaaaaggaaaaagaaaataaatgcaggagatcttccaaaattcagagcaccccccaccgcccaataaatgaaaaatatgagagaagacagaagaccaatataagaggtccaaagttaaacagtagtccccatagagaaaatgaaagcatgtaaattagtaatttttttttaaaaaaaagagttgacaaaagtattcagattgaatgaccacagtacaacgagtgaacaagacacaactctagacatattctcatgagatttcaggacactaaaaataaggagacgaaatcctaaaaacttccagggaaggaagagaaaagaagggcacctacaaaagaaccataataagattggcatcaggcatttgttgcatttgttactctgcatactagaagagatgcctccaaagttaggagaaaaaatgattttcaacttggaaccctatactcagccaatcaagtgtaagagtagaagaaaggtatttcaggcatgcagtgactcagaagacctatctgttacaatgcttttggttacaagtaacagaaaagaaaactgaagctggctcattcagtaagaaagtccatcctatctgagtccctagctcaggtaggacaggccccagccacagtgcaatcaccagctaagcaacggcatcaagacccaggttcttcccgtttctctgctccgccttccttggtgagcaggctttatcctcaggctttgtccctcagtctgaggttacagaagagcccccagcaacacctttctcacttactccagtgagagaaaaagagaaagtcttccctgaacgtgccatggaagtccttcccttcagtctgagtgaaccaacttagatcgtatgtccatccttgaccagtaacagttgccaaaggaatgcaatgtgtggaatgacttaaggatcctttctgaagttgggaataaggtagaaaggtgaataatatcaggattctgttaggaatgggcaaagaagaaatggatatggggtaggtgacaacggtatccactacagtttactccccatgcactctatctgagcacattatttaaggatgcagtccagaaaacgagggagtaaaccatgtgaaaggaagatatgggttttaagacacgggctccaacccaagagcccagtgaggagaaggtccaggtacagctgtatatgcaaccttaaatcaaagagcagatacttgcccagattgcagaagggcagaggccttccaagagaaaggtcttcagtggggaaaaagccgaatcgtacgaaataaacagcactgctaatagcattttacaacataatcaaggaggaatagtaaacaaaataaaaaggcaactagaaatggtgggcaaaacaaagagctatataagcaagccaaggtttgaatatgaagtagattaaatcctagcaaggattttaagcaggtgacagagtctaagaaaagggaatccatttgaccttgattggtcattctcctttgagtggtccagatctgtaaagaaggaaatgtaatcctgggcacattcattatttggtctcgccaagaacaatactcacatgtgtaataatgtaaataatgttattttcgactttagaattaagctacaacttggctgtggttgcagggcagaacacacatgttaacaaatgcaagaatgggtatggtcaagtacagcttttaagacgcagaagttaaggagggaaagtggaaggaaaagtagggttattaatatccttatcttaaaaagaggggaactgacatatggactaaaatactgtttaaaatttacagagaaatgtgggcttggcatggtagctcacacctgtaatcccagcactttgggaggccaaggcaggcagatcacctgaggtcaggagtttaagaccagcctggccaacatggtgaaaccccgcctctactaaaaatacaaaaattagcccagtgcactggtgtgcgcctgtagtcccagctactcaggaggctgaggcacgagaattgcttgaacccgggaggcagaggtttcagtgagccgagatcacatcactgcactccagcctgggcgacagagtgagactccatctcaaaaaaaaaattacagagaaatgtgaatatgaatttcaacatggggaggtaacgtaagctaagtcattctctttcatttcagggagttaacacagttccctaaagttggcaaatcaagaaagatgtataagcatatgatttaattttggaggtaaccatcaaaggaactaaaatcagaaacagttaaaagctgtcatgtctgagtcagggaagggaaggggaaggggtagactgctgtttttacgatgacctcttttgttatatctaacttgttgccgagtagttgcaatattttgataaaaattcaaaacccaaaccaccttacccttcatgttttctatcgctctgatgttaacattcaaaatcctgcatgatccagcccctgttgacctctctgatggcccggaccctttgccactctcccctaacccctcgttcagctcctgccacacaggactaagctcttgccagactgagggccttcacacatgctcttctccatctggaaagcctttttcctctctgcaccttgcccacttctgttcaaccctcggttccctgcatcggcgttgcctccttggggaaggcaggctgagctgttcccccattgtacagtcatgagtcgctcaacaacagggatatgttctgagaaatgtgtcattgggcgatttatttgtgctaacatcagagagtgttcttacacaaatctagatggtgtagcatactacacacctaggctatacggtatatagcctattgctcctgggctataaaactgtacagcatggtactatactgaatactgtagatcactggaacacaatggtaagtatttgtatatctaaacatagaaaaggtacagtaaaaatatggcattctaatcttatgggaacaccactgtatgtgtgctctgttgtcggttgaaacgttgttgtgcagcacgtgactgtagaggactggagtggctcccacctccatacttgtccttctgaacacttaagtactggtacaattatctaagatctgtctctgccgctaaagtcaagctccatgaggacaggtaccaaatctgtctaggttaccccatccctgcctaacacagggcctgaggtactatagataccttacttactcaattgtggaatgaattgatggactatagcctgatgtactgcaaatccttcagcatgcagcaggaatggaacttggtgtttaaactaaactataatggctagatgaaaaagagactaaatgtgaaataattccatcattcagaattgagtgttggtataacaaacagacccatgaaatatgtagcgtttcacaaggatatcagtgaggaagttgttcaatatgtcatccgaagtcccgttgcataatgatacttgcacacgcatgcttatagcagcacaattcacaattacaaaaatatagaaccagcccaaatgcccatcaatcagaaagtgaatagagaaattgtggcatatatatacaaaggaatactactcagccataaaaaggaatgacttaatggcattcacagcaacctggatggaactagagactattattctaagtgaagtaactcaggaatggaaaaccaaacaccgtatgttctcactcataagtgggagctaagctatgaggatgcaaaggcatcagaatgatacaatggactttggggacttgagggaaagggtgggagggggtgagggataaaagactacaaattgggttcagtgtacactgctcgggtgatgggtgcaccaaaatctcagaaatcaccattaaagaacttactcatgtcaccaaataccacctgttcccctaaaatctatgggaataaaaaattaagaaaataaataaaattttaaaaggaaggtcatccctacacttcaagttataaaataattctaccgtaaaaaaaaaaaaaacacacacacacacaacaacaacaaagtcctgttgcgtacctctgagaggtgttttgtggcttggactagcatactggcagtgcagatgctgagaagtggttggcctaacaggacttgctgacagatcagggatgatgagagaaagagcagaatcagggcgggtgcagtggctcacgcctgtaatcccagcactttgggaggctgaggtgggcggatcacaaggtcaggagttcaggaccagcctggccaacatggtgaaaccccatctctactaaaaatacaaaaaattagccaggcccagctactcaggaggttggggcagaagaattgcttgaacccgggaggcggaggttgcagtgagccaagattgcaccactgcactccagcctggatgacgagaatgagactccgtatcaaaaaaaaaaaagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgcgccactgcagtccgcagtccggcctgggcgacagagcgagactccgtctcaaaaaaaaaaaaaaaaagaaagagcagaatcaaggatgactcctagaattttggactgagtaactgggtggatgttgatattgtttactgaaatagagacaacatgaggaataggtttgaagggggaaaaaaatcaagactgggacttgttaaatttgagacacttatgagcaactcaagtaaatgctgacgaggccatcaaatctggagctcaagagagaggtttgaaatgcagaaacagggttgtagccatcagcaggcagacatatcatcattcagagtcatgaacatgcagaaataatggaaatgcctcttaattaaatgaaggcatagacatacaacgaaatgttatgtgattactaaaaatgatggtagaaaaacattatccagaagttatctttatctgtagatgacagatttatggacaatttttacttttcatctttgcatattttctgaaaattttttgtccattgaacatgtattacttttataataagaaaatgcaggctgggcacagtggctcacgactgtaatcccagcactttgggaggccaaggcaggaagatcacttgaggccagcagtttgaggccagcctgggcaacatagtgaaatcccatttctgcaaaaaatattttaaaaattagccaggcgtcgtgacatgtgcctgtagtcttagctatcttggaggctgaggtaggtggaatacttgaaactggaggtggaggctgtagtgagctgtgacatcactgcactccagcctgagcaacagagcaagagcctgtctcaaaacaaaaacaaaaacaaaaaagaaaatgcaagttaagttattttcattttagggaaaagtgaagatatacgtctatttttatggacatggatatttacaacattttgttgaggaaaggtagcaagttacaaaagtacatatatgatctcattcatctaaaacaatatgtgggccaggcacagaggtgcacacttgtaatcccggcactttgggaggccgaggcggaaggatcgtttgagcaaaggagtttgagaccagtctgggcaacatggtgaaactccgtctctacaaaaaaaatacaaaaattagctgggcatggtagcggacacctgtagtcccacctacttgggaggctgattgggaggatcacttgcacccaagaggtcgaagctgtagtgagctgtgattgcaccactgtgctccagcttgggcgacagaccttgtctcaaaacaacaacaacatgtgtacgtgcttacaggcaaataagaaagactctagaaggatgtttaaaatgccaacagcaggcccagcgtggtggctcatgcctgtaatcctagcactttgggaggccgaggtgggcagatcacaaggtcaagagatgaagaccatcctggccaacatggcgaaaccctatctctactaaaaatacaaaaattagctgggcatggtggcgcgcacctgtagtcccagctagtcaggaggctgaggcgggagaatcgcttgaaccagggaggcagaggttgcagtgagctgagatcgcaccactgcactccagcctggcgacagtgtgactctgtctcaaaataaataaataaataaataaataagtaagtaataaaataaaatgccaacagcaaaagtaacttttaggctattatgcaccaacaaatttatgtgatatcgagaagtgttaaacagttttagttgcattacactttgcataatatacacaaaacactaaacatgttaataaatgtttgatataataagatgacctaagtttaagtgtaattttgactccttttactgtacctgtgttttcccccactaactgactagtcaagtgctgactggtttttaagagatggggtcttgctctgttgcccaggctggcctcaaactcctgggctcaagtgattttcccacctcagcctcccaagtaggtggaactacaggtgtgcatcaccatacccggcttaacgtctgtttttatatttgtagccacatggtacaaagtacagaacaggtgttcttaacctttttctgccatggacccttttggccttctggacccctcctcagaagaatgttttgaaatgtgtaaaatgcacagaaattaacaacatatttcaagagttcgttctcaaataatatgtgcttcttcagtaaatcattaaataaccagatctagagatgggtctaataattaccttaagtttgaagcagtgatggacatatatatttcaaaatatctgtaacaactataatatgatatgaaagtatctttgatctctactggtgacagtcactgctattctaatactaccatgatctgttgcttacaattgtcattgaagaaaatgtggatttttttttttttttttgagacagagtctcgctctgtcgcccaggctggagtgcaatggtgtgatcttggctcactgcaacctctaccttccgggttcaagtgattctcctgcctcagcctccggagtagctgggattacaggcgcccaccaccatgcccggctgatttttgtatttttagtagagacaggatttcaccatgttggtcaggctggtctcaaactcctgacctcaggtgatctgcctgcctcagcctctcaaagtgctgggattacaggcatgagccaccacacccggctggattttttttttttttaaaagacagggtcttgctatgttgcccaggctggtctcaaactcctgggctcaagtgatctgccctccacgggcttccaaagcactgggattacaggcacgagccaccatgcccagctaaaaatctgggttttcagagacattagtgaaaataaagagtgaatgtttttcccatccaaggtcacagacccggctgaattctcaaccaaagttggaggccttggtctagaaagatacataccaaatattaacagcagttttttttttttttggatagtggaatcgccagagtgattctattttgttttatgatatttttgtagagatagggtctcaatatgttgctcaggctggtcttgaactcctgggctcaaaagatcctcccaccttggcctcccaaagtgctgggattacaggcgtgagccatggcatgcctggcctaattttttatctttgtacctatacgcattttcaaagttttgtacaatgatgttttacaattaaaatttataagagcttaataaatactatgtatttgtttgtcttaaacaacctggaaggatgactaggaaattttatacaactgactacagatgttcaaccttctataactacttaagtgttatgatgactctaatcattcccatgttcttacaagccaagaaaaaaactcactagaattatttattctggagttaaaaagaacaaaaaaacaaactgtcacaactgcagacatttgtctatttttttgccaagtgtaattccaaaaacagctgaaaatattagaacaaattagtacttaatatggactaataccttctgctgtttacaaaaacacaaaacccggaagtacacagaaacttgtattttaaaaataagttattgtgtgtagaaagacttaaaatacaacttatctaagtaatgccaaaacttacataccaccagacaaagtgctttaatgctttatttttatttttttgagacagagtctcgctctgtcacctaggctagagtgcagtggctcgatctctgctcactgcaacctccacctcctgggttcaagcaattctcctgcctcagcctcccgagtagctgggattacaggcgcccgccaccatgcccggctaatttttgtatttttagtggagatggggtttcactatattggctaggctggtcttgaactcctgacctcaagtgatctacccgcctcggccttctaaagtgctaggaatataggcgtgagccaccacacccggccgaaaatgctttaatgttttaaaaaatgagtcatacatagaaagtaagcacatgcttgaaagtgctcatgttcaagttttagcagcaatgtggaatgttgcaaaagagacagggacacagggaaatgtgcatatctcagaagcctactttgctttctttcaaatctaaaaataaaacctttggactgccctattaataagtctagaaaatggatgcttttttttgtggaaagctttcgcaaacatggaaataaaaatatcttcttctcggttaacaggactaaaggatgtaaacataaaccagatgccaatccttgtttctctacaatccccttctccctcatggctctggacaggcttctattgtaaaactatttctatggcacaaggagacatatcaaatgaatgaacattggtctgcacggagcaatacagaccaggttcaaaagtcaaatgttgagtgaaaagagtaagttgtaggatgttccacatagtaggatatcatccagtaaatttgcaaaacactttattccatgttgtcatgtgtaatacaacaaaaaccttgcatggggagtatctcggtgacctttagggagcaggctaccttggggaagcagggcagacaaagagtgcaaccacagggctgggaattcagctgaatctgtcctatttgagttccatagtaagagggctgacaggaatacgaccaactgataacatttcctaagtctgggtgaaaagtacccaaacagctactacttgagctgagcgtagaagccaggaaggaagagggcgggggaagacaggaccttagaatgacgccaggaagaatggtggaagagctgacagcatggaggaagagctgggaacagcgcttagggcccacctcctgagcccaggcttggggagttacagcagtgctgtccacaggggctcatcagagtggacctggtacttgacaagacaggagtcagcttgctcacacactgcttcctttaccatcaaagtcttatgtaaaaataaaaaataaaaaatcagtagaactaagcagcgtactttgtaccacagctgactcccattccatgtaagctcctgaccttctcacagcccagcactttcgtgcattagacaatgaactgtgctggagaagatgatgcctgttcccatgagtctcccaggtctcctgggacagaagtgaagggaaagaagggtccatgaagagacctggagtggagtgggagccccaggggcccagtggatagggtggggtggaaaaggacagcatagatgggcagagcacctcacgctgccttctggggcccagggaacatctaagagtgtgacggggcctggaaagaaagccgagcctggccgggcgtgggggctctcacctgtaatcccagcactctgggaggccgagacgggtggatcacctaaggtcaggagtttgaggccaacatggtgaaactccgtctctactaaaaatacaaaaattaaccgggcatggtggcgggtgcctgtaatcctagctgcttgggaggctaaggcagaagaattgcttgaaccctggaagtgggggttgcagtgagccgagatcatgccattgcactccagcctgggtgacagagaaagacgtctcaaaaaaaaaaaaaaaaaaaaaagaaagaaaaaagaaaaaaagaaaaatgctcctctccacatgtcctggctggttgttcatgcctcgtcttcacacagtggactctctgaatgggcctgagagattctctcctgtcagagcctctacacatgctggtccttccaaaagactcatgcatctctccccactgatgctttgtccttgacctagctaatgtttccttgctgttcaggtcttagatgccatttttcaaagaagtctcctccctgacctacctcccaattcttggtaggatctcctctgatttttatgtgctcccttagtggctggaacttctctccatcacagaagttagcctcttgtaaagtcatagcccatttgcctgtctgtacctcccattagaccagaagactgctgagggtaggatagtttccagcagctagcacagtaactgacacataataaatgctcaattagtacagcttaaaaaagtactgctatataaagagttcaacagtcacagaacaacaaagcaaccacagcctgttcctgaatacttctaggacacctcttatgcatattacagcatgaggaggcagaaggtccagcagcagagggagattctccaaccccgagtaccaaggaactaccacaacctagaatggtcccaaaataaaaatgctccactttcttcaaggttcacaaacaagaactggcaagttccccttgtcgagtaaaaaggtccttccctcacatgccctactcagatgaggtcacttttgatgaaatggaagtttccaaagttttgctttctagtgctaactgctaaaaacttcttcctagcctaacagctctgtgatctctacaaacagtattgcagtgataaattcgtatgcttatctacttacacgcaactttttctctaatggtctgcaaataaaaggctactcttgtcgggctccatggctcatggttgtaatctcggcactttgggaggccaaggcaggaggattactcaagcccaaggagttcaagaccagcctgggcaacacagtgaaaccccgtgtctaccaaaaataaaaataaaaataaaaataaaaaatttagccaggcatggcggcacatccctgtagtcccagctacaagagagcctgaggtgggaggatcacatcagccccggagttcaaggctgcagtaagctatgatcatgctgttgcactccagtctgggtgatggagtgggatcctgtctctaaaaaaacattaaaaaaaataagtaaaaaatttaaaaactggttaaataaattgtggtacatccataacagactatttaaacccaacccttaaaaggaatgatacggctctgtatgaaccgattctaaataatctacaggatacattaaaataaacaaatgtgcacaatattttatagtatgtgtaaaaacacaacgcccacatacccttgtgtatttatacacacatgtaaaatatatacacaaacctaaacacacaaaaatatgtccaatagagacaaagagtagaatagtagttgccagagggtggggtgggggaaaggggagaagtgggagttagtgtttaataggtatgaaatttcagttttgcaagacgaaaggttgtagagatggatggtagtaatggctgtacaacaatgtgaatgtactcagtgccactgaactgtacagttaagatgattaaaactgtaaattgttatatatatcgatatatattttttgagacggagtctcggtctgtcgcccaggctggagtgcagtgacgcgatctcggctcactgcaagctccgcctcctgggttcacgccattctcctgcctcaggctctcagagtagctgggactacaggcgcccgccaccatgcccggctaattttttgtatttttagtaaagacgaggtttcaccgtgctcgccaggatggtctcgatctcctgacctcgtgatcagcctgcctcggcctcccaaagtgctgggattacaggcgtgagccaccacgcccagcctgttatatatattttataataaaaatttaacacacgggtacacacacgcttttttttttgagatggagtctcattctgttgccaggctggagtgcagcggcgtgatctcagttcactgcaacctctgcctcccaggttcaagcgattctcctgcctcagcctcccgagtagctgggactacaggtgcccgccaccatgcccggctaattttttgtatttttagtagagatggggttttaccatgttggccaagatggtctcgatctcttgacctcatgatccacccacctccacctcccaaagtgctaggattacaggcgtgagccaccgtgcccggccacaatttttttttttttttaaagaaacaggtaatagtggctgcctccagggaaagaaatgaatgtttggggcagggtagcagagatactttacaatataactcttttttttttttttttgagacggagttccgctcttgtcgtccaggctggagtgcaacggcatgatcttggctcactgcaacctctgcctcccaggttcaggcgattctcctgcctcagcttcccaagtagctgggactacaggcacgcaccaccacgcttggctaatttttgtatttttagtggagacggagtttcaccatgttggccaggctagtctcgaattcctgacctcaagtgatcaagctgcctcagcctcccaaactgctgggattacaggcatgagccaccatgcccagccccatataacttttttctattattatttttctgagatggagtctcactctgtcgcccaggctggagtgcaatggcacgatcttggctcactgcaacctctgcctcctgggttcaaacgattcttctgcctcagcctcccgagtagctggattacaggtgcataccaccaagcccagctaatttttgtatttttagtagaaatgatgtttcgtcatgttggctaggctggtctcgaactcctgacctcaggtgatccacccacctcggcctcccaaagtactgggattgcaggcgtgagtcactgtgcccagccccgtataactttttacaccacctttttaattccgtattgtccatctaactattcaaaaaatcatttaaaaaaccccggccttatacaagaagtcttttccttaatcgtgtcatttattctatccctcttcctttaagtaaaaaatattttcaatcaaaatcagaattcgacttcagctttgagggtatttattagattcaaataatgcaatttataaaaattacacttgctaccctaaaaatatattcactaaaagccttttctttttttcttttttctttttttttttttttaaagagacagtgtcttactctaaagaacgaggctgcccaggctagagtacaggagtacagtggtgtgatgatggctcactgtagcctaaaactcctgggctcatgggatcctctcacctcatcctcccgagtagctgggactacaggcatgagccaccatgcctggcccctctatttttatcaggtgttacagaaaagcttcaaaatcatcatggaagaaaattatcatttttaccagtacaaaacttttattgcatcccaaccaagctaagatgaatacagaattgtttcaacagaagttaccattatcataattcaagacaaaaatcagccggcaattacatgagttggaaaacaaactactcttatgtcacagtctaccctaaagctccaacttatgtcagaatttaaaatacacacacatatacacaaccctgtggattcctcctcatttatgtaaaacctacttttgtgatgatctgctattttcttgagtcttctggaatgaacactgtagccccactcccggataaggagaagataccacttccagggcttagcactgcccctggcttgaagcagatactcaaatatttgttgggtgaatgaatgattgtctgctgatagggctgcccatcaagcctcataaagaaaaaattcagaaaaaagcaactttatagagaaaataggaaaaagtttaagagatattttgctcacttgaagaaatcagcatttgttaaaggtgaagactggattgactggttcatcaagtggcttagacacaactgactaagtgggctataccttatcccaccccaaagttaaatacaaaacaggtatttttttttttaatcacaggaaaaacacagggcaacttaactataaaattattatttttattttttatttttgagacagagcctcactctatcgcccaggcaggagtgcagtggcgtgatcttggctcaccgaaacttctgcctcctgggttcaagcgattctcctgcctcagtcaccccagtagttgagattacaggtgcccgccaccacgcctggctaatttttgtatttttagtagagacgggatttcaccatcttggccaggctggtcttgaactcttgacctcaggtgatccacccgcctcagcctcccaaagtgctgggattacaggcatgagccaccgcatctggcccttttgtatgtattaaatacgtatgtatgaatataatacatcatcaggttttttaggaagaaaatatagatgactattgatctgttgttaagagtaggaaaggatttcctggcggggcgcggtggctcacgcctgtaatcccagcactttgggaggcagagacgggcggatcacaaggtcaggagatcgagaccagcctggctaacatggtgaaaccctgtctctactaaaaatacaaaaaaattagccaggcgtggtggcgggcgcctgtagtcccagctactcgggaggctgaggcaggagaatggaatgaacccgggagatggagcttgcagtgagccaagatcacgccattgcactccaacctgggcgacagagcgagactccgtctcaaaaaaaaaaaaaaaaaaaaaaaaaaagagtaaaaaaggatttcctaagtatgaaagcaaaagaataaatcataacataaattttatatatcagaaagacaagaatcaagacgtaagacaaaacaggaaaatatctgcatgacaaagagttaacatctttaatacattaagagctatgacaatgattattgaggtttagcctcagtaataatccaagcggcaccaatttaaaagatgtatatccaattctgggacgatatgggaaaatggcactttctcagactgttgtgggaactgggatagccattttggacagtgatgtggtggtatccaccagaaattccaagtctaggcagccattcttcaaaatgactggcacatgaggaatttcaatcctgtagcatttttaataacatagagagacaacgaaatgcatgacggtaagtcagccctggactacactgctatttaaaagaaatgaggcagagatgaatatatgagatggaaaaatgcagaatatgtatatataacaccatcctgaggccaggcacggtggctcacgcctgtaatcccagcactttgggaggccaaggcaggtggatcgcctgaggtcaggagttcgacaccagcctggccaacatggtgaaacccatctctactaaaaatacaaaaattagctgggtgtggtggcaggcgcctgtaatcccagctactcaggaggctgaggcaggagaatcacttgaacccaggaggtggaggttgcagtgagccaagattgtgccactgtactccagcctggatgacagagcaagactccatctcaaaaaaagaaaaaacaaaacaaaacaaaaaccctcctgttaattacaacacaaaaagtacacagtttagtcttagaagacttagaaggatctacattaagctattaacagcagttattctgggtagtgggagcagagattaagcggggagctttcatttttttacctgatacttttttttttttttttttttgagaccgagtctcactctgtcacccaggcaggagtgcagtggtgtgatcttggctcactgcaacctccgcctcccaggttcaagtgattctcctgcctcagccttccgagtagctgggactacacgctcaagccaccatggccagctaatttttgtatttttaatagagatggggtttcgccgtgttagccaggctggtctcgaactcctgacttcaggtgatccacccgcctaggcctcccaaagcgctgtgattacaggcatgagccaccttgcccagccacctgatcaatttttaagtggtttgatttttctataaatccatgtattattttagtaattctttaaaaagtaaaagaagaaaaatagatatcaagcatttatctactaaagacgggtactgtcctttgagaattccctcaaaagttctttgaagctcaaatggctacatctttcccattcataagatactttttaaatttcctctttctacatttctttttaaaagtttattttcaattagcttcctcaggttgaactctctgtacatttcttaggagaaactgtatggtgtcaacactgcctgttttataacatccattcgtaatctgtaatctgagaaaaagactcgtaaaaacccaaaccaccctccaggcctaacatcttccagaagaaacccattcactgcccatattacatttagtccacacaatttctgagacaaagcacaaagcactagccatacaactcccaccagcataaatacgtggagtacaaagaatgtcctgtcagctgggcccagagcacaccccacagcagtaaaagagaatgacaatttgagtcacaggatcaggagcagaatcaaatttgggacttgaggcagtgtgatgctcttctggtcttccgcttccttccacaccttctattctccttcagccaaaccttgccctcacataatccctaagcaggctatttcttatggatgtctacaacagcttcacactgaggtgtcagaaaccactagagagacaacaaagaacgacttagggtctcagtcggaatcacaatggccgcataagtgaaaactcacatttttgcttaggggaaaaaaaatgggaaaattcaattggaacattctgctttaccacacagaagttctgaaatccacatgtcaaaacatcaaatgcggagtgaccactaatcaaaaagacaaaacaaaacaacaacaacaacaacaacaacaaacagcttgagatgttgagcctgaaggttgagaaattaaggaaccattcatttttacaaaactaaagtccacacaatggtgccaagtagttcaaactgcagctgatacagcacctgagtgtcagacctagaatgactggggcccccaggtttttacaaagtactcatcctcctctagagtcccaagaaccagatgtatatctgggtactctctttagttaccatgggaggagtgtagcaagcacatgacattagccatggcccccggtgttctgagacagctttcaggagggtgtccttctagggaaccaaccacataccagttcccatatctgaaaatgcattaccactgctcactaatgttgaccactaagccatttaccccaaaccaaagcaaacacatgctgaagaccgctaaggcaacagcagcagcgcaaaagggctcagtgcaagcgctctcagctcagctgacctgcttcaaggtgaactgaagttgcagatcaccagttccggctctaatctgacgcccgcccccagatcacgctgtggcgaccaagtaaccctacacacactgacctttcagggctcagggaagtgacttttttttattatatggcacagtttggcacagttatgtctttagtctttggggtacttttatactgtccaagagtagtatatttttttcctcttttccttttttttttttttttaaaaaaaaaaaaaacagatggccaaaccaggacatatactaaaaaaaaaaaaaggaaggttacttacctgagccctaacatcccagctaccatggaatcctgttggagctggtctacagaagcaaggtgtattctggggagtcacatgtcacatcaaagcaggaactggtgagtctgtatttttatggagcctaaaacaaagaaaattgtaagttgaaagcccccattgagctgcacgacctttttcccagggctatttgggacattttgaagataaacacatagacaaagtactaggctatttcccagcttacctagctagaaacaaaggataagctgcaaattactggcacgtaacacacagtgctaaaataaaggaaagattcatgcttgttagaatcaacactatcacaagccttgtcacctctaggggacacttcgacactacaaaagcataccatgagtggcgatttctggcaagtatttcttctaccacggcacacagaaattctcagggaagaatacatgttcaagagaatacgcaacatcaaaataccatccctgaaagaacacatggaacctagaggcagtctcccttctttttcaagcagctgaatgaagttgcaataagctgctgtaacaacatcacataaaggggctttaatcctgagagaaaaaatcagcaccaagggaaaccaagtgctctgggagacccaaagccatcatccaaaacatgcaagtctatttcagggcaatcagttttaagcctctcagatcagtcaatctcgatgttcaacaaactcagttattagtttgatagtttctctttttcttttgaacacatgttcaaaaaaggacttttgtcagtaccttttttgtcattaagataaccatcatttcctagttaaagcctaaactgccccatatgaattagctaatttctgatactatgctggcccaagagtagcacttttataagctaaaaacgaaagctcagagcatacaacttagagactattcacacaattactcatgtaatcaaacccagaagaagggcaacaccaaccaagtcttttactggtctgttgctgctctacagctaccaggatggtacctaaaattatcttttgaggttcagtgaggcctcataattcccttaaacagtcaagtcatagaatactttgaaatcccagaagtcaagttaatagtattactcggctagctatataataaaaaccaaactggtatcctggctaggaggccctggaaaagtcacaacttctcagggacacaagttttttttgtttgtaaactgatggtgctggactaagaatccttctagttcttaaagtttaagataattaacttaagatttcatgtcaaaaagaaaagagccagaggctgggtgcggtggctcacgcctgtaatccctgcactttgggaggctgaagcgggtggatcacgaggtcaggagttcaagaccagcgtggccaagatggtgaaaccccgtctcgactaaaaaaaaaaaaaaaaaaaaaaaaaaaatacaaaaattagccaggcgtggtggcaggtgcctgtaatcccagctacttgggaggctgaggcagagaactgcttgagcccgggaggcagaggttgcagtgagctgagatcgtgccactgcactccagcatgggtgacagagtgagactgtctcaaaaaaaaaaaaaaaaaaagaaagaaagaaaagagaaaatgagagcagtttatgaaatctaaaaaagaaagttaatatatatataaaacacccctagctcttgggctaggaagacaagtgcatccttactaaggcttggtcctgtcaacttcagaggcaataatgagagcccagactacagtgtctacagtaactgcaaaacagccacacagcacagcgggaacacattcacacgccaggagacccagcatacatgtgcttgaagaagttataagactcaggctttattctctaacgaaatggtcattccccctttgatgtgggggtgggggtggggatgccctgcccaccccccaattccggctcccactcagttatcccacataccatacataccatcaaagtatttaagcaatggcatgcaaagcaagctttcgacaggtttcttgcaagagaaaggcagaagagaacaggtaaaagcagaagagcacacaggtaaaagcagaagagcacaacttctacttaagcccaaagaagagggacctgttcacatcttgtcctacccggaatgatgcacacgcacaggggcttgccgggacagcagtagtttcactggaaagggctggtatggaggcaccgaggacaaggtccttccatcgcagcggtgataatgctctacccaagaaaaaaagattgcgtctgccagccacgcaagactggtctgcaaggatgtcaccatagcagagggcagggaaaacaagcaggtgtcctgccacactctttgggactggccagtctaggagtgtgctttaccccacgcactgaaaacactggttactagaaatatcaaacatttcctgtgattctctcctccaagataactcgggcagcttgagaacaagctgctcttagctaattaaaagatttctgctgatattaacctttataaaagatttcaggttccaggacacgtcatttatcatgcagagtcccaagcaggtacattagcaatggaaaccaggctccaataaggaactaacaattttatctctgttgttctttattttaggttaaagaaatgaacttctcgtttcatctccacatgggaggaatgttctggagggggtaacagcctattaaactcatctagctttttttttttttttcaaactccacagcttgcctccctaccctactagactagattgcacagaggcagggcaggcacgggaaacgactctggttggaaattacaaacatatacacacagaatgcaagcaccataaccctttgaatacacagtggtttgtgccttgccccagacctacctaaggatttaaacagcacagaagtcggagttcggctgactgcatgacactctcctatcaatcgggtgaaacaaagacccagtactctaagcttaaagcattccaggcaaaattttagttaacaggcaataggaaggtgtgataggccagtgctaacaagaaagccacagatgggtttctttgagctgttaagacactggaaagggctggtatggaagcccagtggagccattaggacaatggaaaaggaggtacccctccaccaggcactttgcagagaaaactatactctggaagctgcctgcactgttgatagggctagacgtatgataaacagctaaccggaggggcacccgaggagacaaactgccaactatgaagaacaaagcagagacctcaacttgtcacgtctcaagctcagatgtacaaactttgggatcgtcaagtgaggctcgtgtgtatgcctggggatatgactgtattccagtgatcagccacctagctgacctgccacgaatgggtgacctgtggtgacttactttaatcaactgtagtacttctagattgattgggtgatttaaggttctgacatattcaggcaagaaaataaaagcaagtgtttcctagacttcctcattgggatttgaaatagaaatcctgaaaagcccataaaagcctatttccctaaatccttggtggaaattcccaaaagattaaaaaatccagaccctgtcttattatagggacccagcagatttcaaaagactcaagaggtcagcttaatctggttattaactgaaattgctgagatactgatgaacattccagccatggaacccaaaattctctagagtaataattacctattagtgcaatgttactactgaggccgtatatgcttcatttttacagtataacaaaatgtctaaaacttatgagagtcctacaacgtctaggccactcagtatcacatccaagtaggtatggttcctggatcaccaaccaacccctgaattcgatcctgttatctcacagtctggggtactgatcccgcacagcagagacacaacgtgtgaaaggctcggcagagcccattcctgttcctggaaaaataaccagaagcacacatctgcctgaccatgagtcaggaatatcaattttgtggtggagcccatttctgctgtgaccaacccacacccgaacacactcgcaacagaagcaaccgccacagagcaattccagaatgagctttttccccctcggggtccatacttagcaatgtcataaacggtctcccctgcgacagcaatccttttacactcttcataatgaccttaagtctttagtgcaaaaccacagaaacattgccactgccatataaaagtcatctgagtttcagtttgggtgattcggtcatgaccaaactgaacagaggataacctttcaggcacaattaacaggagccacagcgtcgcgatgaacttgccccatctggtaccggtgatcccgagcgctccagggcgatgagagcccgttacctactatgtcccactccacttatgtaactggaagatcgccggcgaaggggagggtaggatgggagggtgctcacattccgaggccacagcactccaaagaacctctgagcaccctggggacacgctcgcaccttagagcctctggcgccgaagagcctcgggtgctgctggacgcacagtcccctacccacggctcctgatgggaactataaccacctctttatgatgagttgtgggacccagaacacaatgtctagtcccttttgtggataataatccccacctacttgttcctgctagatggggaaaggagccggtggacctactcgctcgcgggggggtagcggggggcagaaattcatggaatgggcgagaaggagggggaggcaaagcccagagatgggggtgagagctcaggagcccttgtggcgcactctcccgacgggaggcgaagtgcgcacgcgcgccggtgggggggccgagtaacgggagagggggcgcgcgagggagggagggggagagcgcgatccagggagaggccggggccgcgggcgcgcgacggcgccgcggcccaaagccccgagaagggcaggagcgcgcgcagccccgacaggcgaaccccggcgacaggggcgcccgcggggccgggggccgggatgcgcgtcgagggcgggaggaagaggggcgtcaggcgaaggcggctccagggaggccgcgccgaggacggtcacccgcgagcacgggtgacgggccgaggggagagtcgccaccggcggcggcgggagggggagggtagagaggagggacgccatccgccagccgtgtcgtccgaccccgcgggcccctcccgcgccacgtcccgcccctgacccccgccccccggcaagggtccccgcccgcggccacggcggtcccactcacagtctctcctcctcgcctcctcctcctcctccgctcggcgcggcggcggcggcggcggccattttccggacggcttttaccacagccctctctccgagaggagggagcgcgcgcgccgccgacgccgg
